US011878999B2

(12) United States Patent
Fox et al.

(10) Patent No.: US 11,878,999 B2
(45) Date of Patent: Jan. 23, 2024

(54) INSECTICIDAL PROTEINS AND METHODS FOR THEIR USE

(71) Applicant: PIONEER HI-BRED INTERNATIONAL, INC., Johnston, IA (US)

(72) Inventors: Ellaine Anne Mariano Fox, San Francisco, CA (US); Naga Kishore Kakani, Fremont, CA (US); Kay Walter, Sunnyvale, CA (US); Takashi Yamamoto, Dublin, CA (US); Yi Zheng, Newark, CA (US)

(73) Assignee: PIONEER HI-BRED INTERNATIONAL, INC.

( * ) Notice: Subject to any disclaimer, the term of this patent is extended or adjusted under 35 U.S.C. 154(b) by 0 days.

(21) Appl. No.: 17/269,314

(22) PCT Filed: Aug. 22, 2019

(86) PCT No.: PCT/US2019/047660
§ 371 (c)(1),
(2) Date: Feb. 18, 2021

(87) PCT Pub. No.: WO2020/046701
PCT Pub. Date: Mar. 5, 2020

(65) Prior Publication Data
US 2021/0347830 A1  Nov. 11, 2021

Related U.S. Application Data

(60) Provisional application No. 62/724,276, filed on Aug. 29, 2018.

(51) Int. Cl.
C07K 14/325 (2006.01)
A01N 63/50 (2020.01)
(Continued)

(52) U.S. Cl.
CPC ............ *C07K 14/325* (2013.01); *A01N 63/50* (2020.01); *A01P 7/04* (2021.08); *C12N 15/8286* (2013.01)

(58) Field of Classification Search
None
See application file for complete search history.

(56) References Cited

U.S. PATENT DOCUMENTS 5,273,746 A   12/1993 Payne et al.
5,407,825 A   4/1995 Payne et al.
(Continued)

FOREIGN PATENT DOCUMENTS

BR   PI9816295 B1   8/2017
WO   9002801 A2    3/1990
(Continued)

OTHER PUBLICATIONS

Bravo, et al.; "Evolution of Bacillus thuringiensis Cry toxins insecticidal activity: Evolution of the Bt toxins"; Microbial Biotechnology (2012) 6(1):17-26.
(Continued)

*Primary Examiner* — Matthew R Keogh
*Assistant Examiner* — Rebecca Stephens

(57) ABSTRACT

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants. Methods to create or alter pesticidal proteins are provided for altered or enhanced pesticidal activity.

26 Claims, 13 Drawing Sheets

Specification includes a Sequence Listing.

(51) Int. Cl.
*A01P 7/04* (2006.01)
*C12N 15/82* (2006.01)

(56) References Cited

U.S. PATENT DOCUMENTS

| | | | |
|---|---|---|---|
| 5,468,483 A | 11/1995 | Thompson et al. | |
| 5,521,286 A | 5/1996 | Payne et al. | |
| 5,530,195 A | 6/1996 | Kramer et al. | |
| 5,686,069 A | 11/1997 | Payne et al. | |
| 6,017,534 A | 1/2000 | Malvar et al. | |
| 6,033,874 A * | 3/2000 | Bau et al. | C12N 15/8286 435/325 |
| 6,780,408 B1 | 8/2004 | Bosch et al. | |
| 10,611,806 B2 | 4/2020 | Baum et al. | |
| 10,634,675 B2 | 4/2020 | Cummings et al. | |
| 10,669,319 B2 | 6/2020 | Kennedy et al. | |
| 11,008,371 B2 | 5/2021 | Abad et al. | |
| 11,492,639 B2 | 11/2022 | Abad et al. | |
| 2005/0124803 A1 * | 6/2005 | Dean et al. | C07K 14/325 435/320.1 |
| 2012/0324605 A1 | 12/2012 | Meade et al. | |
| 2014/0109263 A1 | 4/2014 | Sheets et al. | |
| 2021/0181204 A1 | 6/2021 | Yarnell et al. | |
| 2021/0277070 A1 | 9/2021 | Abad et al. | |
| 2022/0243221 A1 | 8/2022 | Baum et al. | |

FOREIGN PATENT DOCUMENTS

| | | |
|---|---|---|
| WO | 0215701 A2 | 2/2002 |
| WO | 2003082910 A1 | 10/2003 |

OTHER PUBLICATIONS

Torres-Quintero, et al.; "Engineering Bacillus thuringiensis Cyt1Aa toxin specificity from dipteran to lepidopteran toxicity"; Scientific Reports (2018) 8(1) DOI:10.1038/S41598-018-22740-9.

Liu, et al.; "Redesigning Bacillus thuringiensis Cry1Aa toxin into a mosquito toxin"; Protein Engineering, Design and Selection (2006) 19(3)107-111.

International Search Report and Written Opinion for International Application No. PCT/US2019/047660 dated Jan. 14, 2020.

International Preliminary Report on Patentability for International Application No. PCT/US2019/047660, dated Mar. 11, 2021, 10 Pages.

* cited by examiner

FIG. 1

Dm2 synthesized (QLTRE to SHRLS)

| Dm1 | Dm2 | Dm3 |

Dm1 synthesized (Met to QLTRE)     Dm3 synthesized (SHRLS to end of the toxin ie AQK or AKK)

FIG. 3

| ECF2 library | | | | | |
|---|---|---|---|---|---|
| Domain-1 | | | Domain 2 & 3 | | |
| α1-2 | α3-5 | α6-7 | | | |
| 1Ea | MP372 | 1Ea | | | |
| 1Ea | MP294 | 1Ea | | | |
| 1Ea | GS047 | 1Ea | | | |
| 1Ea | Eb | 1Ea | | | |
| 1Ea | Ah | 1Ea | | | |
| 1Ea | Ae | 1Ea | X | 1Ea | 1Ca |
| 1Ea | Ad | 1Ea | | | |
| 1Ea | Ab | 1Ea | | | |
| 1Ea | Aa | 1Ea | | | |
| MP372Dm1 | | | | | |
| MP294Dm1 | | | | | |
| GS047Dm1 | | | | | |
| Dm2 and Dm3 were fused at WTHRS crossover region-2 | | | | | |

| ECF3 library | | | | | |
|---|---|---|---|---|---|
| Domain-1 | | | Domain 2 & 3 | | |
| α1-2 | α3-5 | α6-7 | | | |
| 1Ea | MP372 | 1Ea | | | |
| 1Ea | MP294 | 1Ea | | | |
| 1Ea | GS047 | 1Ea | | | |
| 1Ea | Eb | 1Ea | | | |
| 1Ea | Ah | 1Ea | | | |
| 1Ea | Ae | 1Ea | X | 1Ea | 1Ca |
| 1Ea | Ad | 1Ea | | | |
| 1Ea | Ab | 1Ea | | | |
| 1Ea | Aa | 1Ea | | | |
| MP372Dm1 | | | | | |
| MP294Dm1 | | | | | |
| GS047Dm1 | | | | | |
| Dm2 and Dm3 were fused at ITQIP crossover region-3 | | | | | |

| ECF4 library | | | | | |
|---|---|---|---|---|---|
| Domain-1 | | | Domain 2 & 3 | | |
| α1-2 | α3-5 | α6-7 | | | |
| 1Ea | MP372 | 1Ea | | | |
| 1Ea | MP294 | 1Ea | | | |
| 1Ea | GS047 | 1Ea | | | |
| 1Ea | Eb | 1Ea | | | |
| 1Ea | Ah | 1Ea | | | |
| 1Ea | Ae | 1Ea | X | 1Ea | 1Ca |
| 1Ea | Ad | 1Ea | | | |
| 1Ea | Ab | 1Ea | | | |
| 1Ea | Aa | 1Ea | | | |
| MP372Dm1 | | | | | |
| MP294Dm1 | | | | | |
| GS047Dm1 | | | | | |
| Dm2 and Dm3 were fused at GFTGG crossover region-4 | | | | | |

FIG. 7

| | | | | Toxin Composition | | | | | | Activity (ppm) | | | | | | | | | |
|---|---|---|---|---|---|---|---|---|---|---|---|---|---|---|---|---|---|---|---|
| | Backbone | SEQ ID NO: | Name | Dm1 | | | | | Dm2 | Dm3 | CEW | | FAW | | ECB | | SBL | | VBC | |
| | | | | α1-2 | α3 | α4 | α5 | α6-7 | | | IC50 | LC50 | IC50 | LC50 | ILC50 | LC50 | ILC50 | LC50 | ILC50 | LC50 |
| IPRS (Insect-active Proteins from Region Shuffling) Constructs | | | | | | | | | | | | | | | | | | | | |
| FAW actives | 1Ea | 59 | IPRS-C13 | 1Ea | | Aa | | 1Ea | 1Ea | 1CaF3 | N.A. | N.A. | 3.4 | 63 | N.A. | N.A. | <3 | <3 | <1 | 16 |
| | | 60 | IPRS-C14 | 1Ea | | Ab | | 1Ea | 1Ea | 1CaF3 | N.D. | N.D. | 4.52 | 185 | N.D. | N.D. | N.D. | N.D. | N.D. | N.D. |
| | | 61 | IPRS-C15 | 1Ea | | Eb | | 1Ea | 1Ea | 1CaF3 | N.D. | N.D. | 5.06 | 168 | N.D. | N.D. | N.D. | N.D. | N.D. | N.D. |
| | | 62 | IPRS-C16 | 1Ea | | MP294 | | 1Ea | 1Ea | 1CaF3 | N.A. | N.A. | <1 | 25 | N.A. | N.A. | <3 | <3 | <1 | 4 |
| | | 63 | IPRS-C17 | 1Ea | | Ad | | 1Ea | 1Ea | 1CaF3 | N.A. | N.A. | 4 | 69 | N.A. | N.A. | <2 | <2 | <1 | 4.5 |
| | | 64 | IPRS-C19 | 1Ea | | MP294 | | 1Ea | 1Ea | 1CaF4 | N.D. | N.D. | 35 | 282 | N.D. | N.D. | N.D. | N.D. | N.D. | N.D. |
| | | 65 | IPRS-C31 | 1Ea | | Eb | | 1Ea | 1Ea | 1CaF4 | N.D. | N.D. | 333 | N.M. | N.D. | N.D. | N.D. | N.D. | N.D. | N.D. |
| | | 66 | IPRS-C18 | 1Ea | | MP294 | | 1Ea | MP372_2F | 1CaF3 | N.A. | N.A. | <1 | 11 | N.A. | N.A. | <3 | <3 | <3 | <3 |
| | | 67 | IPRS-C32 | 1Ea | | MP294 | | 1Ea | 1Cb | 1CaF3 | 78 | 164 | 38.6 | N.M. | 19 | 2000 | <1 | <1 | 0.17 | 1 |
| | | 68 | IPRS-C33 | 1Ea | | MP294 | | 1Ea | 1Ea | IfF3 | N.D. | N.D. | 63 | N.M | N.A. | N.A. | 0.7 | 2.1 | 2 | N.A. |
| | | 69 | IPRS-C34 | 1Ea | | MP294 | | 1Ea | 1Ea | 9EbF3 | N.D. | N.D. | 5 | 234 | N.D. | N.D. | 0.75 | 1.3 | 2 | N.M |
| | | 70 | IPRS-C35 | 1Ea | | MP294 | | 1Ea | MP372_2F | 1CbF2 | 13 | 151 | 7 | 580 | 45 | N.M | 1 | 1 | 2 | 125 |
| | | 71 | IPRS-C56 | 1Ea | | MP294 | | 1Ea | MP372_2F | 1AeF3 | N.D. | N.D. | 17 | N.M | N.D. | N.D. | N.D. | N.D. | N.D. | N.D. |
| | | 72 | IPRS-C57 | 1Ea | | MP294 | | 1Ea | 1Ea | 1BbF3 | N.D. | N.D. | 14 | N.M | N.A. | N.A. | 1 | 1.1 | 2 | N.M |
| | | 73 | IPRS-C58 | 1Ea | | MP294 | | 1Ea | MP372_2F1 | 1CaF3 | N.D. | N.D. | 40 | N.M | N.D. | N.D. | N.D. | N.D. | N.D. | N.D. |
| | | 74 | IPRS-C59 | 1Ea | | MP294 | | 1Ea | 1Ga_2F1 | 1CaF3 | N.D. | N.D. | 168 | N.M | N.D. | N.D. | N.D. | N.D. | N.D. | N.D. |
| | | 75 | IPRS-C71 | 1Ea | | MP294 | | 1Ea | GS028_2F1 | 1CaF3 | N.D. | N.D. | 25 | 325 | N.D. | N.D. | N.D. | N.D. | N.D. | N.D. |
| | | 76 | IPRS-C72 | 1Ea | | MP294 | | 1Ea | 1Eb_2F1 | 1CaF3 | N.D. | N.D. | 7 | 47 | N.D. | N.D. | N.D. | N.D. | N.D. | N.D. |
| | | 77 | IPRS-C73 | 1Ea | | MP294 | | 1Ea | 1Eb_2F2 | 1CaF3 | N.D. | N.D. | 3.2 | 46 | N.D. | N.D. | N.D. | N.D. | N.D. | N.D. |
| | | 78 | IPRS-C74 | 1Ea | | MP294 | | 1Ea | GS028_2F2 | 1CaF3 | N.D. | N.D. | <1 | 24 | N.D. | N.D. | N.D. | N.D. | N.D. | N.D. |
| | | 79 | IPRS-C36 | 1Ea | Da | MP294 | | 1Ea | 1Ea | 1CaF3 | N.D. | N.D. | 15 | 51 | N.D. | N.D. | N.D. | N.D. | N.D. | N.D. |
| | | 80 | IPRS-C37 | 1Ea | MP294 | | Aa | 1Ea | 1Ea | 1CaF3 | N.D. | N.D. | 3.2 | N.M | N.D. | N.D. | N.D. | N.D. | N.D. | N.D. |
| | | 81 | IPRS-C38 | 1Ea | MP294 | Ad | MP294 | 1Ea | 1Ea | 1CaF3 | N.D. | N.D. | 5.1 | N.M | N.D. | N.D. | N.D. | N.D. | N.D. | N.D. |
| | | 82 | IPRS-C39 | 1Ea | MP294 | | Ae | 1Ea | 1Ea | 1CaF3 | N.D. | N.D. | 2.4 | N.M | N.D. | N.D. | N.D. | N.D. | N.D. | N.D. |
| | | 83 | IPRS-C52 | 1Ea | MP294 | | Db | 1Ea | 1Ea | 1CaF3 | N.D. | N.D. | 17 | N.M | N.D. | N.D. | N.D. | N.D. | N.D. | N.D. |
| | | 84 | IPRS-C53 | 1Ea | MP294 | | Dc | 1Ea | 1Ea | 1CaF3 | N.D. | N.D. | 6.2 | N.M | N.D. | N.D. | N.D. | N.D. | N.D. | N.D. |
| | | 85 | IPRS-C54 | 1Ea | MP294 | | Eb | 1Ea | 1Ea | 1CaF3 | N.D. | N.D. | 4.1 | N.M | N.D. | N.D. | N.D. | N.D. | N.D. | N.D. |
| | | 86 | IPRS-C55 | 1Ea | MP294 | | Hb | 1Ea | 1Ea | 1CaF3 | N.D. | N.D. | 42.5 | N.M | N.D. | N.D. | N.D. | N.D. | N.D. | N.D. |
| | 1Ja | 87 | IPRS-C51 | 1Ja | | 1Ca | | 1Ja | 1Ja | Ja | N.D. | N.D. | 376 | N.M | N.D. | N.D. | N.D. | N.D. | N.D. | N.D. |
| CEW actives | 1Jc | 88 | IPRS-C21 | 1Jc | | 1Ca | | 1Jc | 1Jc | Jc | <1 | 20 | N.A. | N.A. | 1.9 | 9 | <1 | <1 | N.A. | N.A. |
| | | 89 | IPRS-C66 | 1Jc | | 1Ca | | 1Jc | 1Jc | 1F2F3 | 20 | 209 | N.A. | N.A. | N.A. | N.A. | 10 | 29 | 865 | N.M |
| | | 90 | IPRS-C49 | 1Jc | 1Aa | 1Ca | | 1Jc | 1Jc | 1Jc | 9.20 | N.M | N.D. | N.D. | N.D. | N.D. | N.D. | N.D. | N.D. | N.D. |
| | | 91 | IPRS-C61 | 1Jc | 1Jc | 1Ca | | 1Jc | 1Jc | 1Jc | 6.37 | N.M | N.D. | N.D. | N.D. | N.D. | N.D. | N.D. | N.D. | N.D. |
| | | 92 | IPRS-C62 | 1Jc | | 1Ca | 1Ah | 1Jc | 1Jc | 1Jc | 3.95 | N.M | N.D. | N.D. | N.D. | N.D. | N.D. | N.D. | N.D. | N.D. |
| | | 93 | IPRS-C63 | 1Jc | | 1Ca | 1Ea | 1Jc | 1Jc | 1Jc | 3.07 | N.M | N.D. | N.D. | N.D. | N.D. | N.D. | N.D. | N.D. | N.D. |
| | | 94 | IPRS-C64 | 1Jc | | 1Ca | 1Jc | 1Jc | 1Jc | 1Jc | 4.18 | N.M | N.D. | N.D. | N.D. | N.D. | N.D. | N.D. | N.D. | N.D. |
| | | 95 | IPRS-C65 | 1Jc | | 1Ca | 1Jd | 1Jc | 1Jc | 1Jc | 2.39 | N.M | N.D. | N.D. | N.D. | N.D. | N.D. | N.D. | N.D. | N.D. |
| | GS062 | 112 | IPRS-C49 | GS002 | | | | | GS062 | GS062 | N.A. | N.A. | N.A. | N.A. | N.A. | N.A. | 12 | | 80 | N.D. |
| | | 97 | IPRS-C45 | GS002 | | | | | GS062 | 1Cb (F2) | 28 | 120 | N.A. | N.A. | 65 | 320 | <3 | <3 | <3 | <3 |
| | | 99 | IPRS-C47 | GS002 | | | | | GS062 | 18e (F3) | 20 | 70 | N.A. | N.A. | 24 | 119 | <3 | <3 | <3 | <3 |
| | | 96 | IPRS-C46 | GS002 | | | | | GS062 | 1Cb (F1) | 12 | 43 | N.D | N.D. | N.D | N.D. | N.D | N.D. | N.D. | N.D. |
| | | 98 | IPRS-C48 | GS002 | | | | | GS062 | 1Da(F2) | 40 | N.M | N.D | N.M | N.D | N.D. | N.D | N.D. | N.D. | N.D. |
| CEW & FAW actives | MP1068 | 100 | IPRS-C23 | MP1068 | | 1Aa | | MP1068 | MP1068 | MP1068 | 5.5 | 62 | 7 | N.M | <2 | 934 | N.D. | N.D. | N.D. | N.D. |
| | | 102 | IPRS-C24 | MP1068 | | 1Aa | | MP1068 | MP1068 | 1Cb (F2) | 2 | 14 | 7 | N.M | 1.12 | 930 | <3 | <3 | 2.3 | 3.5 |
| | | 103 | IPRS-C25 | MP1068 | | 1Aa | | MP1068 | MP1068 | 1Cb (F3) | <1 | 15 | 3 | N.M | 11 | 567 | <5 | <5 | 1 | 1 |
| | | 104 | IPRS-C26 | MP1068 | | 1Aa | | MP1068 | MP1068 | 1Da (F3) | 17 | 260 | 148 | N.M | N.D | N.D. | N.D | N.D. | N.D | N.D. |
| | | 105 | IPRS-C27 | MP1068 | | 1Aa | | MP1068 | MP1068 | 1Ja (F2) | 11 | N.M | 5 | N.M | N.D | N.D. | N.D | N.D. | N.D | N.D. |
| | | 106 | IPRS-C28 | MP1068 | | 1Aa | | MP1068 | MP1068 | 1Ja (F3) | 9 | 580 | <1 | N.M | N.D | N.D. | N.D | N.D. | N.D | N.D. |
| | | 107 | IPRS-C29 | MP1068 | | 1Aa | | MP1068 | MP1068 | MP258 (F4) | 2.19 | 27 | 5.5 | N.M | N.D | N.D. | N.D | N.D. | N.D | N.D. |
| | | 109 | IPRS-C41 | MP1068 | | 1Aa | | MP1068 | MP1068 | MP258 (F2) | 5 | 100 | 16 | N.M | N.D | N.D. | N.D | N.D. | N.D | N.D. |
| | | 108 | IPRS-C42 | MP1068 | | 1Aa | | MP1068 | MP1068 | MP258 (F3) | <1 | 25 | 3.6 | N.M | 1.2 | 105 | <2 | <2 | 120 | 1020 |
| | | 110 | IPRS-C43 | MP1068 | | 1Aa | | MP1068 | MP1068 | MP258 (F5) | <1 | 31 | 4.5 | N.M | 1 | 427 | <3 | <3 | 61 | 266 |
| | | 111 | IPRS-C44 | MP1068 | | 1Aa | | MP1068 | MP1068 | 1Bb (F3) | 11.4 | 224 | N.A. | N.A. | N.D. | N.D. | N.D. | N.D. | N.D. | N.D. |

FIG. 8

| Alpha 3 to part of Alpha 5 shuffling | | | | | | | | | |
|---|---|---|---|---|---|---|---|---|---|
| | Alpha-3, Alpha-4 and Part of Alpha-5 | | | | | | | | |
| Used in | | | | | | | | | |
| 1. Example 3: 1. CryIJ Alpha3-5 shuffling (for IPRS hits C21 and C51) | | | | | | | | | |
| 2. Example 4: DmIAlpha3-5 and Dm3 shuffling on Cry1Ea backbone for IPRS hits: C13, 14, 15, 16, 17, 19 and 31 | | | | | | | | | |
| 3. Example 5: Sequential Alpha3-5 and Dm3 shuffling on MP1068 backbone | | | | | | | | | |

Anchor sequences used in Alpha-3-5 shuffling of Cry toxins:

| 5' end | | | | | | 3' end | | | |
|---|---|---|---|---|---|---|---|---|---|
| Q | I | E | Q | L | | A | N | L | H | L |
| H | V | L | R | I | | V | F | F | | |
| R | M | | E | | | | | | | |
| | L | | L | | | | | | | |
| | | | S | | | | | | | |

Alpha 3, Alpha 4, Alpha 5 (complete), Alpha 3-4, Alpha 4-5 and Alpha 3-5 (complete alpha 5)

FIG. 10

| IPRS Variant Name | Amino Acid SEQ ID NO: | DNA SEQ ID NO: | IPRS Variant Name | Amino Acid SEQ ID NO: | DNA SEQ ID NO: |
|---|---|---|---|---|---|
| IPRS-C11 | 57 | 1 | IPRS-C54 | 85 | 29 |
| IPRS-C12 | 58 | 2 | IPRS-C55 | 86 | 30 |
| IPRS-C13 | 59 | 3 | IPRS-C51 | 87 | 31 |
| IPRS-C14 | 60 | 4 | IPRS-C21 | 88 | 32 |
| IPRS-C15 | 61 | 5 | IPRS-C66 | 89 | 33 |
| IPRS-C16 | 62 | 6 | IPRS-C49 | 90 | 34 |
| IPRS-C17 | 63 | 7 | IPRS-C61 | 91 | 35 |
| IPRS-C19 | 64 | 8 | IPRS-C62 | 92 | 36 |
| IPRS-C31 | 65 | 9 | IPRS-C63 | 93 | 37 |
| IPRS-C18 | 66 | 10 | IPRS-C64 | 94 | 38 |
| IPRS-C32 | 67 | 11 | IPRS-C65 | 95 | 39 |
| IPRS-C33 | 68 | 12 | IPRS-C46 | 96 | 40 |
| IPRS-C34 | 69 | 13 | IPRS-C45 | 97 | 41 |
| IPRS-C35 | 70 | 14 | IPRS-C48 | 98 | 42 |
| IPRS-C56 | 71 | 15 | IPRS-C47 | 99 | 43 |
| IPRS-C57 | 72 | 16 | IPRS-C23 | 100 | 44 |
| IPRS-C58 | 73 | 17 | IPRS-C44 | 101 | 45 |
| IPRS-C59 | 74 | 18 | IPRS-C24 | 102 | 46 |
| IPRS-C71 | 75 | 19 | IPRS-C25 | 103 | 47 |
| IPRS-C72 | 76 | 20 | IPRS-C26 | 104 | 48 |
| IPRS-C73 | 77 | 21 | IPRS-C27 | 105 | 49 |
| IPRS-C74 | 78 | 22 | IPRS-C28 | 106 | 50 |
| IPRS-C36 | 79 | 23 | IPRS-C29 | 107 | 51 |
| IPRS-C37 | 80 | 24 | IPRS-C42 | 108 | 52 |
| IPRS-C38 | 81 | 25 | IPRS-C41 | 109 | 53 |
| IPRS-C39 | 82 | 26 | IPRS-C43 | 110 | 54 |
| IPRS-C52 | 83 | 27 | IPRS-C44 | 111 | 55 |
| IPRS-C53 | 84 | 28 | IPRS-C49 | 112 | 56 |

FIG. 11

| Cry Variant Alpha Loop 3-5 Fragment | Amino Acid SEQ ID NO: | DNA SEQ ID NO: |
|---|---|---|
| 1Ac | 159 | 137 |
| 1Ab | 160 | 138 |
| 1Aa | 161 | 139 |
| 1Ag | 162 | 140 |
| TA009 | 163 | 141 |
| 1Db | 164 | 142 |
| 1Ea | 165 | 143 |
| 1Eb | 166 | 144 |
| 1Ah | 167 | 145 |
| 1Ca | 168 | 146 |
| 1Cb | 169 | 147 |
| 1Hb | 170 | 148 |
| 1Gc | 171 | 149 |
| 1Ja | 172 | 150 |
| 1Jb | 173 | 151 |
| 1Jd | 174 | 152 |
| 1Jc | 175 | 153 |
| 1Gb | 176 | 154 |
| 1Ga | 177 | 155 |
| 1La | 178 | 156 |
| 1Ka | 179 | 157 |
| 1Ma | 180 | 158 |

FIG. 12

| Proprietary Cry Toxin Name | DNA SEQ ID NO: | Amino Acid SEQ ID NO: |
|---|---|---|
| MP1068 | 181 | 214 |
| MP372 | 182 | 215 |
| GS062 | 183 | 216 |
| GS028 | 184 | 217 |
| MP294 | 185 | 218 |
| MP627 | 186 | 219 |
| MP265 | 187 | 220 |
| MP626 | 188 | 221 |
| MP596 | 189 | 222 |
| MP477 | 190 | 223 |
| GS062 | 191 | 224 |
| MP047 | 192 | 225 |
| GS030 | 193 | 226 |
| GS150 | 194 | 227 |
| GS074 | 195 | 228 |
| MP252 | 196 | 229 |
| GS135 | 197 | 230 |
| MP547 | 198 | 231 |
| GS148 | 199 | 232 |
| MP310 | 200 | 233 |
| GS155 | 201 | 234 |
| TA006 | 202 | 235 |
| GS018 | 203 | 236 |
| MP071 | 204 | 237 |
| MP448 | 205 | 238 |
| MP315 | 206 | 239 |
| MP310 | 207 | 240 |
| MP316 | 208 | 241 |
| MP327 | 209 | 242 |
| TA005 | 210 | 243 |
| GS128 | 211 | 244 |
| MP259 | 212 | 245 |
| MP250 | 213 | 246 |

FIG. 13

| Cry Toxin Domain 3 regions showing altered activity when swapped to another Cry toxin | Amino Acid SEQ ID NO: |
|---|---|
| Cry1F | 259 |
| Cry1Cb | 260 |
| Cry1Fa | 261 |
| Cry9Ea | 262 |
| Cry1Ae | 263 |
| Cry1Bb | 264 |
| Cry1Ca | 265 |
| Cry1Da | 268 |
| Cry1Ja | 269 |
| Cry1If | 270 |

INSECTICIDAL PROTEINS AND METHODS FOR THEIR USE

CROSS-REFERENCE TO RELATED APPLICATIONS

This application claims the benefit of U.S. Provisional Application No. 62/724,276, filed Aug. 29, 2018, which is hereby incorporated herein in its entirety by reference.

REFERENCE TO SEQUENCE LISTING SUBMITTED ELECTRONICALLY

The official copy of the sequence listing is submitted electronically via EFS-Web as an ASCII formatted sequence listing with a file named "6806_SeqList" created on Aug. 19, 2019, and having a size of 825 kilobytes and is filed concurrently with the specification. The sequence listing contained in this ASCII formatted document is part of the specification and is herein incorporated by reference in its entirety.

FIELD

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants. Methods to create or alter pesticidal proteins are provided for altered or enhanced pesticidal activity.

BACKGROUND

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae, B. lentimorbus, B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of *Bacillus thuringiensis*. These genetically engineered crops are now widely used in agriculture and have provided the farmer with an environmentally friendly alternative to traditional insect-control methods. While they have proven to be very successful commercially, these genetically engineered, insect-resistant crop plants may provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and the order Coleoptera, including but not limited to insect pests that have developed resistance to existing insecticides.

SUMMARY

In one aspect compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. Compositions also comprise transformed bacteria, plants, plant cells, tissues and seeds.

In another aspect isolated or recombinant nucleic acid molecules are provided encoding a shuffled Cry toxin polypeptide including amino acid substitutions, deletions, insertions, and fragments thereof. Provided are isolated or recombinant nucleic acid molecules capable of encoding shuffled Cry toxin polypeptides of SEQ ID NOS: 57-112 and 275-278, as well as amino acid substitutions, deletions, insertions, fragments thereof, and combinations thereof. In certain embodiments, polynucleotides are provided that encode insecticidal polypeptides, wherein the polynucleotides comprise a nucleic acid sequence as set forth in any one of SEQ ID NOS: 57-112, 214-246, and 275-278. Nucleic acid sequences that are complementary to a nucleic acid sequence of the embodiments or that hybridize to a sequence of the embodiments are also encompassed. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant.

In another aspect shuffled Cry toxin polypeptides are encompassed. Also provided are isolated or recombinant shuffled Cry toxin polypeptides of SEQ ID NO: 57-112 and 275-278, as well as amino acid substitutions, deletions, insertions, fragments thereof and combinations thereof.

In another aspect methods are provided for producing the polypeptides and for using those polypeptides for controlling or killing a Lepidopteran, Coleopteran, nematode, fungi, and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may comprise any gene imparting an agronomic trait of interest.

In another aspect methods for detecting the nucleic acids and polypeptides of the embodiments in a sample are also included. A kit for detecting the presence of a shuffled Cry toxin polypeptide or detecting the presence of a polynucleotide encoding a shuffled Cry toxin polypeptide in a sample is provided. The kit may be provided along with all reagents and control samples necessary for carrying out a method for detecting the intended agent, as well as instructions for use.

In another aspect the compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of shuffled Cry toxin polypeptides.

In another aspect methods for shuffling Cry toxin polypeptides comprising swapping alpha loop domains of domain 1 (Dm1) from a first Cry toxin into a second Cry toxin are provided. In some embodiments, the shuffled Cry toxin polypeptide has an altered spectrum of activity. In another embodiment, the shuffled Cry toxin polypeptide has an altered amount of pesticidal activity. In some embodiments, the shuffled cry toxin polypeptide has an altered mode of action or site of action. In some embodiments, the shuffling comprises swapping alpha loops 2, 3, 4, 5, and/or 6 from a first Cry toxin into a second Cry toxin. In some embodiments the Cry toxin is a native Cry toxin. In some embodiments, the Cry toxin is a shuffled or hybrid Cry toxin.

BRIEF DESCRIPTION OF THE FIGURES

FIG. 1 shows different holotype Bt Cry toxin domain fragments (Dm1, Dm2 and Dm3) that were optimized for *E. coli* expression and synthesized and used for some shuffling reactions and templated for fragment PCR. The border sequences are shown for the junctions of Dm1, Dm2, and Dm3 (SEQ ID NOs: 266 and 267 respectively).

FIG. 3 shows a library design to shuffle several hybrid domain 1 (Dm1) with Cry1Ea domain 2 (Dm2) and Cry1Ca domain 3 (Dm3) at three different cross over points having different lengths of Cry1Ca Dm3. Hybrid Dm1s differ at alpha 3-5 region. Along with 9 hybrid Dm1s, three Cry1Ea-like Dm1 hybrids were designed. Dmf and Dmf alpha fragments of different Cry toxins were mixed with Cry1Ea and Cry1Ca Dm2-Dm3 fusion fragment to create different novel Cry toxin variants. Cry1Ea and Cry1Ca Dm2s were fused at different crossover points; WTHRS (ECF2 library, SEQ ID NO: 251), ITQIP (ECF3 library, SEQ ID NO: 252) and GFTGG (ECF4 library, SEQ ID NO: 253).

FIG. 7 shows a list of all IPRS-C variants generated using different Cry toxin fragment shuffling. Domain composition of all variants indicated. Dm2 and Dm3 fusion crossover points (F) were also indicated. Specific activities (IC50 and LC50) of all these variants were determined against CEW, FAW and ECB and listed as tested. Variants in the table are divided based on their activity against FAW, CEW, or both.

FIG. 8 shows a fragment of Dm1 (Alpha loop 3-part of Alpha loop 5) shuffled in examples 1, 2 and 3. Shaded areas are anchor sequences where the shuffled fragment was fused to the backbone. Usually, the 5' anchor sequence motif is QIEQL (SEQ ID NO:247) and 3' anchor sequence motif is ANLHL (SEQ ID NO:250). Diversity at each of these anchor sequence positions was also listed below the normal anchor sequence motif in columns.

FIG. 10 shows IPRS variant produced (with associated SEQ ID NOs.) as described in the Examples.

FIG. 11 shows Cry toxin Alpha loop (with associated SEQ ID NOs.) that may be used for Alpha loop swapping.

FIG. 12 shows proprietary Cry toxins showing insecticidal activity (with associated SEQ ID NOs.) that may be used for shuffling as described herein.

FIG. 13 shows Cry toxin Dm3 regions (with associated SEQ ID NOs.) that showed altered activity when swapped to another Cry toxin.

DETAILED DESCRIPTION

Figure 2:
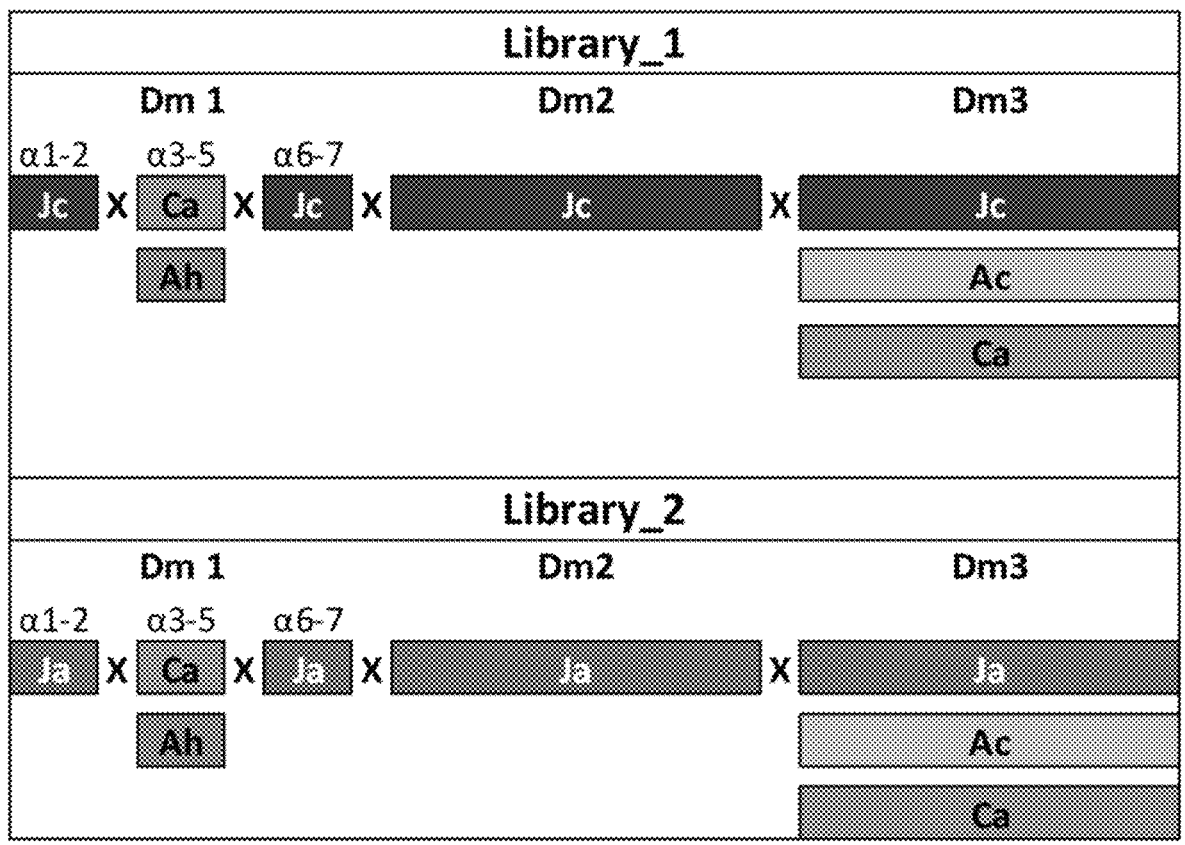
FIG. 2 shows a library schematic of 12 constructs that were synthesized as described in Example 2 for swapping of alpha loops 3-5 of various shuffled Cry toxins. In Library-1, Dm1 alpha fragments of Cry1Jc, Cry1Ca and Cry1Ah were mixed with Dm3 fragments of Cry1Jc, Cry1Ac and Cry1Ca along with Cry Dm2. Six constructs were synthesized. In Library-2, Dm1 alpha fragments of Cry1Ja, Cry1Ca and Cry1Ah were mixed with Dm3 fragments of Cry1Ja, Cry1Ac and Cry1Ca along with Cry1Ja Dm2. Six constructs were synthesized.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof, and so forth. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with nucleic acid sequences encoding shuffled Cry toxin polypeptides. In particular, the nucleic acid sequences of the embodiments are useful for preparing plants and microorganisms that possess pesticidal activity. Thus, transformed bacteria, plants, plant cells, plant tissues and seeds are provided. The compositions include pesticidal nucleic acids and proteins of bacterial species. The nucleic acid sequences find use in the construction of expression vectors for subsequent transformation into organisms of interest, as probes for the isolation of other homologous (or partially homologous) genes, and for the generation of altered shuffled Cry toxin polypeptides by utilizing aspects of certain methods known in the art, such as site directed mutagenesis, domain swapping, or DNA shuffling. The shuffled Cry toxin polypeptides find use in controlling or killing Lepidopteran, Coleopteran, Dipteran, fungal, Hemipteran and nematode pest populations and for producing compositions with pesticidal activity. Insect pests of interest include, but are not limited to, *Lepidoptera* species including but not limited to: Corn Earworm, (CEW) (*Helicoverpa zea*), European Corn Borer (ECB) (*Ostrinia nubialis*), diamond-back moth, e.g., *Helicoverpa zea* Boddie; soybean looper, e.g., *Pseudoplusia includens* Walker; and velvet bean caterpillar e.g., *Anticarsia gemmatalis* Hubner and Coleoptera species including but not limited to Western corn rootworm (*Diabrotica virgifera*)—WCRW, Southern corn rootworm (*Diabrotica undecimpunctata howardi*)—SCRW, and Northern corn rootworm (*Diabrotica barberi*)—NCRW.

By "pesticidal toxin" or "pesticidal protein" is used herein to refer to a toxin that has toxic activity against one or more pests. For example, pests may include members of the Lepidoptera, Diptera, Hemiptera and Coleoptera orders or the Nematoda phylum or a protein that has homology to such a protein. Pesticidal proteins have been isolated from organisms including, for example, *Bacillus* sp., *Bacillus thurengiensis* ("Bt"), *Pseudomonas* sp., *Photorhabdus* sp., *Xenorhabdus* sp., *Clostridium bifermentans* and *Paenibacillus popilliae*.

In some embodiments a shuffled Cry toxin polypeptide includes an amino acid sequence deduced from the full-length nucleic acid sequence disclosed herein and amino acid sequences that are shorter than the full-length sequences, either due to the use of an alternate downstream start site or due to processing that produces a shorter protein having pesticidal activity. Processing may occur in the organism in which the protein is expressed in or in the pest after ingestion of the protein.

In another aspect, methods are provided for shuffling a Cry toxin polypeptide comprising swapping or shuffling alpha loop domains of domain 1 (Dm1) from a first Cry toxin into a second Cry toxin, creating a heterologous alpha loop region in the second shuffled Cry toxin.

In some embodiments, the methods and compositions disclosed herein relate to shuffling or swapping all or parts of a domain 3 (Dm3) from a first Cry toxin (a heterologous portion) into a second Cry toxin, creating a heterologous domain 3 region in the second Cry shuffled or swapped toxin. In some embodiments, the shuffled or swapped domain 3 occurs at any one of the crossover points as set forth in SEQ ID NOs: 250-257. In some embodiments, the heterogous portion of domain 3 comprises a fragment derived from a Cry1If, Cry1Cb, Cry1Fa, Cry 9Eb, Cry1Ae, Cry1Ja, Cry1Da, Cry1Bb, or Cry1Ca toxin or any one of SEQ ID NOs: 259-265 or 268-270.

In some embodiments, the shuffled Cry toxin polypeptide has an altered spectrum of activity. In another embodiment, the shuffled Cry toxin polypeptide has an altered amount of pesticidal activity. In some embodiments, the shuffled cry toxin polypeptide has an altered mode of action or site of action. In some embodiments, the shuffled cry toxin polypeptide has an altered solubility.

In some embodiments, the shuffling comprises swapping or shuffling whole or portions of alpha loops 2, 3, 4, 5, and/or 6 from a first Cry toxin into a second Cry toxin, which creates a heterologous alpha loop region. In some embodiments the Cry toxin is a native Cry toxin. In some embodiments, the Cry toxin is a shuffled or hybrid Cry toxin derived from a native Cry toxin. In some embodiments, the alpha loop swapping or shuffling occurs at a sequence motif comprising at least 90% or having at least 95% sequence identity to any one of SEQ ID NOs: 247-250.

In another embodiment, the alpha loop swapping or shuffling occurs at a sequence motif comprising variant of SEQ ID NO: 247, wherein the variant comprises 1) a histidine or arginine at position 1 of SEQ ID NO: 247; 2) a valine, methionine, or leucine at position 2 of SEQ ID NO: 247; 3) a leucine at position 3 of SEQ ID NO: 247; 4) an arginine, glutamic acid, leucine, or serine at position 4 of SEQ ID NO: 247; or 5) an isoleucine at position 5 of SEQ ID NO: 247.

In another embodiment, the alpha loop swapping or shuffling occurs at a sequence motif comprising variant of SEQ ID NO: 250, wherein the variant comprises 1) a valine position 1 of SEQ ID NO: 250; 2) a phenylalanine at position 2 of SEQ ID NO: 250; or 3) a phenylalanine at position 3 of SEQ ID NO: 250.

In another embodiment, the alpha loop swapping or shuffling occurs at a sequence motif comprising variant of SEQ ID NO: 248, wherein the variant comprises 1) a asparagin, serine, threonine, or arginine at position 1 of SEQ ID NO: 248; 2) an arginine at position 2 of SEQ ID NO: 248; 3) an aspartic acid, glycine, or alanine at position 4 of SEQ ID NO: 248; 4) an arginine, glutamic acid, leucine, or serine at position 4 of SEQ ID NO: 248; or 5) an alanine, serine, threonine, glutamic acid, or valine at position 5 of SEQ ID NO: 248.

In another embodiment, the alpha loop swapping or shuffling occurs at a sequence motif comprising variant of SEQ ID NO: 249, wherein the variant comprises 1) an arginine, alanine, threonine, lysine, or glycine at position 1 of SEQ ID NO: 249; 2) a threonine, serine, valine, isoleucine, or glutamic acid at position 2 of SEQ ID NO: 249; 3) a serine, isoleucine, proline, alanine, arginine, threonine, glycine, or asparagine at position 3 of SEQ ID NO: 249; 4) an asparagine, glutamine, glutamic acid, glycine, aspartic acid, serine, or threonine at position 4 of SEQ ID NO: 249; or 5) a phenylalanine, glutamic acid, tyrosine, or glutamine at position 5 of SEQ ID NO: 249.

In another embodiment, the alpha loop swapping or shuffling occurs at a sequence motif comprising variant of SEQ ID NO: 258, wherein the variant comprises 1) a glutamic acid, alanine, serine, arginine, lysine, or threonine at position 2 of SEQ ID NO: 258; 2) an alanine, glycine, or glutamic acid at position 3 of SEQ ID NO: 258; or 3) a serine or phenylalanine at position 4 of SEQ ID NO: 258.

Thus, provided herein are isolated or recombinant nucleic acid sequences encoding shuffled Cry toxin polypeptides conferring pesticidal activity. Also provided are the amino acid sequences of shuffled Cry toxin polypeptides. The polypeptides resulting from translation of these shuffled Cry toxin genes allows cells to control or kill pests that ingest it.

Members of *B. thuringiensis* insecticidal protein classes are known to one skilled in the art (see, Crickmore, et al., Microbiology and Molecular Biology Reviews (1998) Vol 62: 807-813; and Crickmore, et al., "*Bacillus thuringiensis* toxin nomenclature" (2016), at btnomenclature.info/ which can be accessed on the world-wide web using the "www" prefix). As used herein, a "Bt Cry toxin," or a "Cry toxin" refers to a parasporal inclusion (crystal) protein from *B. thuringiensis* that exhibits some experimentally verifiable toxic effect to a target organism, or any protein that has obvious sequence similarity to a known Cry protein (Crickmore, et al., Microbiology and Molecular Biology Reviews (1998) Vol 62: 807).

Shuffled Cry Toxin Proteins and Variants and Fragments Thereof

Shuffled Cry toxin polypeptides are encompassed by the disclosure. "Shuffled Cry toxin polypeptide," and "shuffled Cry toxin protein" as used herein interchangeably refers to a polypeptide(s) having insecticidal activity including but not limited to insecticidal activity against one or more insect pests of the Lepidoptera and/or Coleoptera orders, and has been shuffled from one or more native Bacillus thurengiensis Cry toxin polypeptides. In some embodiments, the shuffled Cry toxin polypeptide comprises a shuffled Cry toxin, wherein the shuffling comprises a heterologous alpha loop swap in domain 1 ("Dm1") or a heterologous fragment of domain 3 ("Dm 3"). A variety of shuffled Cry toxin polypeptides are contemplated. Sources of shuffled Cry toxin polypeptides or related proteins include bacterial species selected from but not limited to Bacillus thurengiensis (Bt) species.

"Sufficiently identical" is used herein to refer to an amino acid sequence that has at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity. In one embodiment the shuffled Cry toxin polypeptide has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to any one of SEQ ID NOs: 57-112, 214-246, and 275-278. The term "about" when used herein in context with percent sequence identity means+/−1.0%.

A "recombinant protein" is used herein to refer to a protein that is no longer in its natural environment, for example in vitro or in a recombinant bacterial or plant host cell.

"Substantially free of cellular material" as used herein refers to a polypeptide including preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to a shuffled Cry toxin polypeptide and that exhibit insecticidal activity. "Fragments" or "biologically active portions" of shuffled Cry toxin polypeptides includes fragments comprising amino acid sequences sufficiently identical to the amino acid sequence set forth in any one of SEQ ID NOs: 57-112, 214-246, and 275-278 wherein the shuffled Cry toxin polypeptide has insecticidal activity. Such biologically active portions can be prepared by recombinant techniques and evaluated for insecticidal activity. In some embodiments, the shuffled Cry toxin polypeptide fragment is an N-terminal and/or a C-terminal truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31 or more amino acids from the N-terminus and/or C-terminus relative to any one of SEQ ID NOs: 57-112, 214-246, and 275-278, e.g., by proteolysis, by insertion of a start codon, by deletion of the codons encoding the deleted amino acids and concomitant insertion of a start codon, and/or insertion of a stop codon. In some embodiments, the shuffled Cry toxin polypeptide fragment is an N-terminal truncation of at least 1, 2, 3, 4, 5, 6, 7, 8, 9, 10, 11, 12, 13, 14, 15, 16, 17, 18, 19, 20, 21, 22, 23, 24 amino acids from the N-terminus of any one of SEQ ID NOs: 57-112, 214-246, and 275-278. In some embodiments, the shuffled Cry toxin polypeptide fragment is an N-terminal and/or a C-terminal truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to any one of SEQ ID NOs: 57-112, 214-246, and 275-278.

"Variants" as used herein refers to proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater identical to the parental amino acid sequence.

In some embodiments an shuffled Cry toxin polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity to the full length or a fragment of the amino acid sequence of any one of SEQ ID NOs: 57-112, 214-246, and 275-278, wherein the shuffled Cry toxin polypeptide has insecticidal activity.

In some embodiments an shuffled Cry toxin polypeptide comprises an amino acid sequence of any one or more of SEQ ID NOS: 57-112, 214-246, and 275-278 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95 or more amino acid substitutions compared to the amino acid at the corresponding position of any one or more of the respective SEQ ID NOS: 57-112, 214-246, and 275-278.

Methods for such manipulations are generally known in the art. For example, amino acid sequence variants of a shuffled Cry toxin polypeptide can be prepared by mutations in the DNA. This may also be accomplished by one of several forms of mutagenesis, such as for example site-specific double strand break technology, and/or in directed evolution. In some aspects, the changes encoded in the amino acid sequence will not substantially affect the function of the protein. Such variants will possess a desired pesticidal activity. However, it is understood that the ability of a shuffled Cry toxin polypeptide to confer pesticidal activity or other polypeptide physical property may be improved or altered by the use of such techniques upon the compositions of this disclosure.

Conservative amino acid substitutions may be made at one or more predicted nonessential amino acid residues. A "nonessential" amino acid residue is a residue that can be altered from the wild-type sequence of a shuffled Cry toxin polypeptide without altering the biological activity. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine);

small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues.

Alternatively, alterations may be made to the protein sequence of many proteins at the amino or carboxy terminus without substantially affecting activity. This can include insertions, deletions, or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling. With such a procedure, one or more different shuffled Cry toxin polypeptide coding regions can be used to create a new shuffled Cry toxin polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc.* *Natl. Acad. Sci. USA* 91:10747-10751; Stemmer, (1994) *Nature* 370:389-391; and U.S. Pat. Nos. 5,605,793 and 5,837,458.

Domain swapping as shuffling is another mechanism for generating altered Cry toxin polypeptides. Domains may be swapped between shuffled Cry toxin polypeptides resulting in hybrid or chimeric toxins with altered insecticidal activity or target spectrum. Methods for generating recombinant proteins and testing them for pesticidal activity are known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-21010; Rang, et al., 91999) *Appl. Environ. Microbiol.* 65:2918-2925).

In some embodiments the shuffled Cry toxin polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to, net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, shuffled Cry toxin polypeptide having increased expression, increased solubility, decreased phytotoxicity, and digestibility of proteolytic fragments in an insect gut. Models for digestion by simulated gastric fluids are known to one skilled in the art (Fuchs, R. L. and J. D. Astwood. Food Technology 50: 83-88, 1996; Astwood, J. D., et al *Nature Biotechnology* 14: 1269-1273, 1996; Fu T J et al *J. Agric Food Chem.* 50: 7154-7160, 2002).

In some embodiments variants include polypeptides that differ in amino acid sequence due to mutagenesis. Variant proteins encompassed by the disclosure are biologically active, that is they continue to possess a desired biological activity (i.e. pesticidal activity) of the native protein. In some embodiment the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

In some embodiments a shuffled Cry toxin polypeptide comprises the amino acid sequence of any one or more of SEQ ID NOS: 57-112 and 275-278.

In some embodiments, chimeric polypeptides are provided comprising regions of at least two different shuffled Cry toxin polypeptides of the disclosure.

In some embodiments, chimeric polypeptides are provided comprising regions of at least two different shuffled Cry toxin polypeptides selected from any one or more of SEQ ID NOS: 57-112, 214-246, and 275-278.

In some embodiments, chimeric shuffled Cry toxin polypeptide(s) are provided comprising an N-terminal Region of a first shuffled Cry toxin polypeptide of the disclosure operably fused to a C-terminal Region of a second shuffled Cry toxin polypeptide of the disclosure.

In other embodiments the shuffled Cry toxin polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.,* 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterification reaction between the two termini to form a branched ester or thioester intermediate and peptide bond cleavage coupled to cyclization of the intein C-terminal asparagine to free the intein (Evans, et al., (2000) *J. Biol. Chem.,* 275:9091-9094).

In another embodiment fusion proteins are provided that include within its amino acid sequence an amino acid sequence comprising a shuffled Cry toxin polypeptide of the disclosure. Methods for design and construction of fusion proteins (and polynucleotides encoding same) are known to those of skill in the art. Polynucleotides encoding a shuffled Cry toxin polypeptide may be fused to signal sequences which will direct the localization of the shuffled Cry toxin polypeptide to particular compartments of a prokaryotic or eukaryotic cell and/or direct the secretion of the shuffled Cry toxin polypeptide of the embodiments from a prokaryotic or eukaryotic cell.

For example, in *E. coli,* one may wish to direct the expression of the protein to the periplasmic space. Examples of signal sequences or proteins (or fragments thereof) to which the shuffled Cry toxin polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs. Ina specific embodiment, the shuffled Cry toxin polypeptide may be fused to the pelB pectate lyase signal sequence to increase the efficiency of expression and purification of such polypeptides in Gram-negative bacteria (see, U.S. Pat. Nos. 5,576,195 and 5,846,818).

Plant plastid transit peptide/polypeptide fusions are known in the art. Apoplast transit peptides such as rice or barley alpha-amylase secretion signal are also known in the art. The plastid transit peptide is generally fused N-terminal to the polypeptide to be targeted (e.g., the fusion partner). In one embodiment, the fusion protein consists essentially of the plastid transit peptide and the shuffled Cry toxin polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. In some embodiments the shuffled Cry toxin polypeptide is fused to a heterologous signal peptide or heterologous transit peptide.

In some embodiments fusion proteins are provide comprising a shuffled Cry toxin polypeptide or chimeric Cry toxin polypeptide of the disclosure represented by a formula selected from the group consisting of:

$R^1$-L-$R^2$, $R^2$-L-$R^1$, $R^1$-$R^2$ or $R^2$-$R^1$ wherein $R^1$ is an shuffled Cry toxin polypeptide or chimeric shuffled Cry toxin polypeptide of the disclosure and $R^2$ is a protein of interest. In some embodiments $R^1$ and $R^2$ are a shuffled Cry toxin polypeptide or chimeric shuffled Cry toxin polypeptide of the disclosure. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments the linkers comprise sequences selected from the group of formulas: $(Gly_3Ser)_n$, $(Gly_4Ser)_n$, $(Gly_5Ser)_n$, $(Gly_nSer)_n$, or $(AlaGlySer)_n$ where n is an integer. One example of a highly-flexible linker is the (GlySer)-rich spacer region present within the pIII protein of the filamentous bacteriophages, e.g. bacteriophages M13 or fd (Schaller, et al., 1975). This region provides a long, flexible spacer region between two domains of the pIII surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments the linker comprises the amino acids from the multi-gene expression vehicle (MGEV), which is cleaved by vacuolar proteases as disclosed in US Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

Nucleic Acid Molecules, and Variants and Fragments Thereof

Isolated or recombinant nucleic acid molecules comprising nucleic acid sequences encoding Cry toxin polypeptides or biologically active portions thereof, as well as nucleic acid molecules sufficient for use as hybridization probes to identify nucleic acid molecules encoding proteins with regions of sequence homology are provided. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecules encoding Cry toxin polypeptides can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments an isolated nucleic acid molecule encoding Cry toxin polypeptides has one or more change in the nucleic acid sequence compared to the native or genomic nucleic acid sequence. In some embodiments the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments the nucleic acid molecule encoding a Cry toxin polypeptide is a non-genomic sequence.

A variety of polynucleotides that encode Cry toxin polypeptides or related proteins are contemplated. Such polynucleotides are useful for production of Cry toxin polypeptides in host cells when operably linked to a suitable promoter, transcription termination and/or polyadenylation sequences. Such polynucleotides are also useful as probes for isolating homologous or substantially homologous polynucleotides that encode Cry toxin polypeptides or related proteins.

Polynucleotides Encoding Polypeptides

One source of polynucleotides that encode Cry toxin polypeptides or related proteins is a *Bacillus* bacterium which may contain a Cry toxin polynucleotide of any one of SEQ ID NOs: 1-56, 181-213, and 271-274, encoding a Cry toxin polypeptide of SEQ ID NOs: 57-112, 214-246, and 271-274, respectively. The polynucleotides of any one or more of SEQ ID NOS: 1-56, 181-213, and 271-274, can be used to express Cry toxin polypeptides in recombinant bacterial hosts that include but are not limited to *Agrobacterium, Bacillus, Escherichia, Salmonella, Lysinibacillus, Acetobacter, Pseudomonas* and *Rhizobium* bacterial host cells. The polynucleotides are also useful as probes for isolating homologous or substantially homologous polynucleotides encoding Cry toxin polypeptides or related proteins. Such probes can be used to identify homologous or substantially homologous polynucleotides, or portions thereof, derived from *Bacillus thurengiensis*.

Polynucleotides encoding Cry toxin polypeptides can also be synthesized de novo from a Cry toxin polypeptide sequence. The sequence of the polynucleotide gene can be deduced from a Cry toxin polypeptide sequence through use of the genetic code. Computer programs such as "Back-Translate" (GCG™ Package, Acclerys, Inc. San Diego, Calif.) can be used to convert a peptide sequence to the corresponding nucleotide sequence encoding the peptide. Examples of Cry toxin polypeptide sequences that can be used to obtain corresponding nucleotide encoding sequences include, but are not limited to the Cry toxin polypeptides of SEQ ID NOS: 57-112, 214-246, and 275-278. Furthermore, synthetic Cry toxin polynucleotide sequences of the disclosure can be designed so that they will be expressed in plants.

In some embodiments the nucleic acid molecule encoding a Cry toxin polypeptide is a polynucleotide having the sequence set forth in any one of SEQ ID NOS: 1-56, 181-213 and 271-274, and variants, fragments and complements thereof "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments the nucleic acid molecule encoding the Cry toxin polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a synthetic nucleic acid sequence.

In some embodiments the nucleic acid molecule encoding a Cry toxin polypeptide disclosed herein is a non-genomic polynucleotide having a nucleotide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity, to the nucleic acid sequence of any one of SEQ ID NOS: 1-56, 181-213 and 271-274, wherein the Cry toxin polypeptide has insecticidal activity.

In some embodiments the nucleic acid molecule encodes a Cry toxin polypeptide variant comprising one or more amino acid substitutions to the amino acid sequence of any one of SEQ ID NOS: 57-112, 214-246, and 275-278.

Also provided are nucleic acid molecules that encode transcription and/or translation products that are subsequently spliced to ultimately produce functional Cry toxin polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate a Cry toxin polypeptide encoding sequence. An example of trans-splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365, 377 and 6,531,316). Thus, in some embodiments the polynucleotides do not directly encode a full-length Cry toxin polypeptide, but rather encode a fragment or fragments of a Cry toxin polypeptide. These polynucleotides can be used to express a functional Cry toxin polypeptide through a mechanism involving splicing, where splicing may occur at the level of polynucleotide (e.g., intron/exon) and/or polypeptide (e.g., intein/extein). This may be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding Cry toxin polypeptides are also encompassed by the embodiments. "nucleotide fragment" as used herein refers to a portion of the nucleic acid sequence encoding a Cry toxin polypeptide. A nucleotide fragment of a nucleic acid sequence may encode a biologically active portion of a Cry toxin polypeptide or it may be a fragment that can be used as a hybridization probe or PCR primer using methods disclosed below. Nucleic acid molecules that are fragments of a nucleic acid sequence encoding a Cry toxin polypeptide comprise at least about 150, 180, 210, 240, 270, 300, 330, 360, 400, 450, or 500 contiguous nucleotides or up to the number of nucleotides present in a full-length nucleic acid sequence encoding a Cry toxin polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the Cry toxin polypeptide and, hence, retain insecticidal activity. "Retains insecticidal activity" is used herein to refer to a polypeptide having at least about 10%, at least about 30%, at least about 50%, at least about 70%, 80%, 90%, 95% or higher of the insecticidal activity of any one of the full-length Cry toxin polypeptides set forth in SEQ ID NOS: 57-112, 214-246, and 275-278. In some embodiments, the insecticidal activity is against a Lepidopteran species. In one embodiment, the insecticidal activity is against a Coleopteran species. In some embodiments, the insecticidal activity is against one or more insect pests of the corn rootworm complex: western corn rootworm, *Diabrotica virgifera*; northern corn rootworm, *D. barberi*: Southern corn rootworm or spotted cucumber beetle; *Diabrotica undecimpunctata howardi*, *Diabrotica speciosa*, and the Mexican corn rootworm, *D. virgifera zeae*. In one embodiment, the insecticidal activity is against a *Diabrotica* species.

In some embodiments the Cry toxin polypeptide is encoded by a nucleic acid sequence sufficiently homologous to any one of the nucleic acid sequences of SEQ ID NOS: 1-56, 181-213, and 271-274.

"Percent (%) sequence identity" with respect to a reference sequence (subject) is determined as the percentage of amino acid residues or nucleotides in a candidate sequence (query) that are identical with the respective amino acid residues or nucleotides in the reference sequence, after aligning the sequences and introducing gaps, if necessary, to achieve the maximum percent sequence identity, and not considering any amino acid conservative substitutions as part of the sequence identity. Alignment for purposes of determining percent sequence identity can be achieved in various ways that are within the skill in the art, for instance, using publicly available computer software such as BLAST, BLAST-2. Those skilled in the art can determine appropriate parameters for aligning sequences, including any algorithms needed to achieve maximal alignment over the full length of the sequences being compared. The percent identity between the two sequences is a function of the number of identical positions shared by the sequences (e.g., percent identity of query sequence=number of identical positions between query and subject sequences/total number of positions of query sequence×100).

In some embodiments a Cry toxin polynucleotide encodes a Cry toxin polypeptide comprising an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater sequence identity across the entire length of the amino acid sequence of any one of SEQ ID NOS: 57-112, 214-246, and 275-278.

In some embodiments polynucleotides are provided encoding chimeric polypeptides comprising regions of at least two different Cry toxin polypeptides of the disclosure.

In some embodiments polynucleotides are provided encoding chimeric polypeptides comprising an N-terminal Region of a first Cry toxin polypeptide of the disclosure operably fused to a C-terminal Region of a second Cry toxin polypeptide of the disclosure.

The embodiments also encompass nucleic acid molecules encoding Cry toxin polypeptide variants. "Variants" of the Cry toxin polypeptide encoding nucleic acid sequences include those sequences that encode the Cry toxin polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the Cry toxin polypeptides disclosed as discussed below.

The present disclosure provides isolated or recombinant polynucleotides that encode any of the Cry toxin polypeptides disclosed herein. Those having ordinary skill in the art will readily appreciate that due to the degeneracy of the genetic code, a multitude of nucleotide sequences encoding Cry toxin polypeptides of the present disclosure exist.

The skilled artisan will further appreciate that changes can be introduced by mutation of the nucleic acid sequences thereby leading to changes in the amino acid sequence of the encoded Cry toxin polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produced by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J. Mol Biol* 255:373-386; Stemmer, (1996) "Sexual PCR and Assembly PCR" In: The Encyclopedia of Molecular Biology. VCH Publishers, New York. pp.

447-457; Crameri and Stemmer, (1995) *BioTechniques* 18:194-195; Stemmer, et al., (1995) *Gene,* 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet* 19:423-462; Botstein and Shortie, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond A*317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundström, et al., (1985) *Nucl Acids Res* 13:3305-3316), double-strand break repair (Mandecki, (1986) *PNAS USA,* 83:7177-7181 and Arnold, (1993) *Curr Opin Biotech* 4:450-455). Additional details on many of the above methods can be found in *Methods Enzymol* Volume 154, which also describes useful controls for trouble-shooting problems with various mutagenesis methods.

The nucleotide sequences of the embodiments can also be used to isolate corresponding sequences from a bacterial source, including but not limited to a *Pseudomonas* species. In this manner, methods such as PCR, hybridization, and the like can be used to identify such sequences based on their sequence homology to the sequences set Antibodies Antibodies to a Cry toxin polypeptide of the embodiments or to variants or fragments thereof are also encompassed. The antibodies of the disclosure include polyclonal and monoclonal antibodies as well as fragments thereof which retain their ability to bind to a Cry toxin polypeptide. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry. Methods for the preparation of the antibodies of the present disclosure are generally known in the art. For example, see, Antibodies, A Laboratory Manual, Ed Harlow and David Lane (eds.) Cold Spring Harbor Laboratory, N.Y. (1988), as well as the references cited therein. Standard reference works setting forth the general principles of immunology include: Klein, J. Immunology: The Science of Cell-Noncell Discrimination, John Wiley & Sons, N.Y. (1982); Dennett, et al., Monoclonal Antibodies, Hybridoma: A New Dimension in Biological Analyses, Plenum Press, N.Y. (1980) and Campbell, "Monoclonal Antibody Technology," In Laboratory Techniques in Biochemistry and Molecular Biology, Vol. 13, Burdon, et al., (eds.), Elsevier, Amsterdam (1984). See also, U.S. Pat. Nos. 4,196,265; 4,609,893; 4,713,325; 4,714,681; 4,716,111; 4,716,117 and 4,720,459. Antibodies against Cry toxin polypeptides or antigen-binding portions thereof can be produced by a variety of techniques, including conventional monoclonal antibody methodology, for example the standard somatic cell hybridization technique of Kohler and Milstein, (1975) *Nature* 256:495. Other techniques for producing monoclonal antibody can also be employed such as viral or oncogenic transformation of B lymphocytes. An animal system for preparing hybridomas is a murine system. Immunization protocols and techniques for isolation of immunized splenocytes for fusion are known in the art. Fusion partners (e.g., murine myeloma cells) and fusion procedures are also known. The antibody and monoclonal antibodies of the disclosure can be prepared by utilizing a Cry toxin polypeptide as antigens.

A kit for detecting the presence of a Cry toxin polypeptide or detecting the presence of a nucleotide sequence encoding a Cry toxin polypeptide in a sample is provided. In one embodiment, the kit provides antibody-based reagents for detecting the presence of a Cry toxin polypeptide in a tissue sample. In another embodiment, the kit provides labeled nucleic acid probes useful for detecting the presence of one or more polynucleotides encoding a Cry toxin polypeptide. The kit is provided along with appropriate reagents and controls for carrying out a detection method, as well as instructions for use of the kit.

Receptor Identification and Isolation

Receptors to the Cry toxin polypeptides of the embodiments or to variants or fragments thereof are also encompassed. Methods for identifying receptors are known in the art (see, Hofmann, et. al., (1988) *Eur. J. Biochem.* 173:85-91; Gill, et al., (1995) *J. Biol. Chem.* 27277-27282) and can be employed to identify and isolate the receptor that recognizes the Cry toxin polypeptide using the brush-border membrane vesicles from susceptible insects. In addition to the radioactive labeling method listed in the cited literatures, a Cry toxin polypeptide can be labeled with fluorescent dye and other common labels such as streptavidin. Brush-border membrane vesicles (BBMV) of susceptible insects such as soybean looper and stink bugs can be prepared according to the protocols listed in the references of Hofmann and Gill above and separated on SDS-PAGE gel and blotted on suitable membrane. Labeled Cry toxin polypeptide can be incubated with blotted membrane of BBMV and labeled Cry toxin polypeptide can be identified with the labeled reporters. Identification of protein band(s) that interact with the Cry toxin polypeptide can be detected by N-terminal amino acid gas phase sequencing or mass spectrometry based protein identification method (Patterson, (1998) 10.22, 1-24, Current Protocol in Molecular Biology published by John Wiley & Son Inc). Once the protein is identified, the corresponding gene can be cloned from genomic DNA or cDNA library of the susceptible insects and binding affinity can be measured directly with the Cry toxin polypeptide. Receptor function for insecticidal activity by the Cry toxin polypeptide can be verified by RNAi type of gene knock out method (Rajagopal, et al., (2002) *J. Biol. Chem.* 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs, particularly polynucleotides and oligonucleotides composed of ribonucleotides and combinations of ribonucleotides and deoxyribonucleotides, may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the Cry toxin polypeptide gene sequence of the disclosure to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter or any other nucleotide or amino acid sequence is "foreign" or "heterologous" to the sequence of the embodiments, it is intended that the nucleotide or amino acid sequence is not the native or naturally occurring promoter or nucleotide sequence for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments the DNA construct comprises a polynucleotide encoding a Cry toxin polypeptide of the embodiments. In some embodiments the DNA construct comprises a polynucleotide encoding a fusion protein comprising a Cry toxin polypeptide of the embodiments.

In some embodiments the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA* ed. Cech (Liss, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2: 1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred usage. For example, although nucleic acid sequences of the embodiments may be expressed in both monocotyledonous and dicotyledonous plant species, sequences can be modified to account for the specific preferences and GC content preferences of monocotyledons or dicotyledons as these preferences have been shown to differ (Murray et al. (1989) *Nucleic Acids Res.* 17:477-498). Thus, the maize-preferred for a particular amino acid may be derived from known gene sequences from maize. Maize usage for 28 genes from maize plants is listed in Table 4 of Murray, et al., supra. Methods are available in the art for synthesizing plant-preferred genes. See, for example, Murray, et al., (1989) *Nucleic Acids Res.* 17:477-498, and Liu H et al. *Mol Bio Rep* 37:677-684, 2010, herein incorporated by reference. A *Zea* maize usage table can be also found at kazusa.or.jp//cgi-bin/show.cgi?species=4577, which can be accessed using the www prefix. A *Glycine max* usage table can be found at kazusa.orjp//cgi-bin/show.cgi?species=3847&aa=1&style=N, which can be accessed using the www prefix.

In some embodiments the recombinant nucleic acid molecule encoding a Cry toxin polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA, ed. Cech* (Liss, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate co-translational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are proteolytically activated in the gut of the target pest (Chang, (1987)*Methods Enzymol.* 153:507-516). In some embodiments, the signal sequence is located in the native sequence or may be derived from a sequence of the embodiments. "Leader sequence" as used herein refers to any sequence that when translated, results in an amino acid sequence sufficient to trigger co-translational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. *Plant Cell* 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., *Photosynthesis Research,* 78:249-264, 2003. In particular, Table 2 of this publication, which is incorporated into the description herewith by reference, discloses 85 proteins from the chloroplast lumen, identified by their accession number (see also US Patent Application Publication 2009/09044298).

Suitable chloroplast transit peptides (CTP) are well known to one skilled in the art also include chimeric CT's comprising but not limited to, an N-terminal domain, a central domain or a C-terminal domain from a CTP from *Oryza sativa* 1-decoy-D xylose-5-Phosphate Synthase *Oryza sativa*-Superoxide dismutase *Oryza sativa*-soluble starch synthase *Oryza sativa*-NADP-dependent Malic acid enzyme *Oryza sativa*-Phospho-2-dehydro-3-deoxyheptonate Aldolase 2 *Oryza sativa*-L-Ascorbate peroxidase 5 *Oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type (See US Patent Application Publication 2012/0304336).

The Cry toxin polypeptide gene to be targeted to the chloroplast may be optimized for expression in the chloroplast to account for differences in usage between the plant nucleus and this organelle. In this manner, the nucleic acids of interest may be synthesized using chloroplast-preferred sequences.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730); ALS promoter (U.S. Pat. No. 5,659,026) and the like. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989)*Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4: 645-656 and Van Loon, (1985) *Plant Mol. Virol.* 4:111-116. See also, WO 1999/43819.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 110:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-la promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156).

Tissue-preferred promoters can be utilized to target enhanced Cry toxin polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7): 792-803; Hansen, et al., (1997) *Mol. Gen Genet.* 254(3): 337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5): 773-778; Lam, (1994) *Results Probl. Cell Differ.* 20:181-196; Orozco, et al., (1993) *Plant Mol Biol.* 23(6):1129-1138; Matsuoka, et al., (1993) *Proc Natl. Acad. Sci. USA* 90(20): 9586-9590 and Guevara-Garcia, et al., (1993) *Plant J.* 4(3):495-505. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

Root-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7):633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, *Plant Science* (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2): 343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US20130117883.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1101), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed. In dicots, seed specific promoters include but are not limited to seed coat promoter from *Arabidopsis*, pBAN; and the early seed promoters from *Arabidopsis*, p26, p63, and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of between about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608, 144; 5,604,121; 5,569,597; 5,466,785; 5,399,680; 5,268,463; 5,608,142 and 6,177,611.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) Ph.D. Thesis, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschmidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36: 913-919; Hlavka, et al., (1985) *Handbook of Experimental Pharmacology*, Vol. 78 (Springer-Verlag, Berlin) and Gill, et al., (1988) *Nature* 334:721-724.

The above list of selectable marker genes is not meant to be limiting. Any selectable marker gene can be used in the embodiments.

Plant Transformation

The methods of the embodiments involve introducing a polypeptide or polynucleotide into a plant. "Introducing" as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide(s) or polypeptide(s) gains access to the interior of at least one cell of the plant. Methods for introducing polynucleotide(s) or polypeptide(s) into plants are known in the art including, but not limited to, stable transformation methods, transient transformation methods, and virus-mediated methods.

"Stable transformation" as used herein means that the nucleotide construct introduced into a plant integrates into the genome of the plant and is capable of being inherited by the progeny thereof "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ Culture: Fundamental Methods, ed.* Gamborg and Phillips, (Springer-Verlag, Berlin) and McCabe, et al., (1988) *Bio/technology* 6:923-926) and Lec1 transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, N.Y.), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*).

In specific embodiments, the sequences of the embodiments can be provided to a plant using a variety of transient transformation methods. Such transient transformation methods include, but are not limited to, the introduction of the Cry toxin polynucleotide or variants and fragments thereof directly into the plant or the introduction of the Cry toxin polypeptide transcript into the plant. Such methods include, for example, microinjection or particle bombardment. See, for example, Crossway, et al., (1986)*Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107:775-784. Alternatively, the Cry toxin polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired Cry toxin polypeptide. It is also recognized that such a viral polyprotein, comprising at least a portion of the amino acid sequence of a Cry toxin polypeptide of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules, are known in the art. See, for example, U.S. Pat. Nos. 5,889,191; 5,889,190; 5,866,785; 5,589,367 and 5,316,931.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), Brassica sp. (e.g., *B. napus, B. rapa, B. juncea*), particularly those Brassica species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus Cucumis such as cucumber (*C. sativus*), cantaloupe (*C. cantalupensis*), and musk melon (*C. melo*). Ornamentals include azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), and chrysanthemum. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesii*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, Brassica, soybean, cotton, safflower, peanut, sorghum, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (Poa trivial's); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, Brassica, maize, alfalfa, palm, coconut, flax, castor, olive, etc. Leguminous plants include beans and peas. Beans include guar, locust bean, fenugreek, soybean, garden beans, cowpea, mung bean, lima bean, fava bean, lentils, chickpea, etc.

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or Agrobacterium vector background, etc.

Plant transformation may be confirmed by Southern blot analysis of genomic DNA (Sambrook and Russell, (2001) supra). In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra). Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the Cry toxin polypeptide.

Methods to Introduce Genome Editing Technologies into Plants

In some embodiments, the disclosed Cry toxin polynucleotide compositions can be introduced into the genome of a plant using genome editing technologies, or previously introduced Cry toxin polynucleotides in the genome of a plant may be edited using genome editing technologies. For example, the disclosed polynucleotides can be introduced into a desired location in the genome of a plant through the use of double-stranded break technologies such as TALENs, meganucleases, zinc finger nucleases, CRISPR-Cas, and the like. For example, the disclosed polynucleotides can be introduced into a desired location in a genome using a CRISPR-Cas system, for the purpose of site-specific insertion. The desired location in a plant genome can be any desired target site for insertion, such as a genomic region amenable for breeding or may be a target site located in a genomic window with an existing trait of interest. Existing traits of interest could be either an endogenous trait or a previously introduced trait.

In some embodiments, where the disclosed Cry toxin polynucleotide has previously been introduced into a genome, genome editing technologies may be used to alter or modify the introduced polynucleotide sequence. Site specific modifications that can be introduced into the disclosed Cry toxin polynucleotide compositions include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. Such technologies can be used to modify the previously introduced polynucleotide through the insertion, deletion or substitution of nucleotides within the introduced polynucleotide. Alternatively, double-stranded break technologies can be used to add additional nucleotide sequences to the introduced polynucleotide. Additional sequences that may be added include, additional expression elements, such as enhancer and promoter sequences. In another embodiment, genome editing technologies may be used to position additional insecticidally-active proteins in close proximity to the disclosed Cry toxin polynucleotide compositions disclosed herein within the genome of a plant, in order to generate molecular stacks of insecticidally-active proteins.

An "altered target site," "altered target sequence." "modified target site," and "modified target sequence" are used interchangeably herein and refer to a target sequence as disclosed herein that comprises at least one alteration when compared to non-altered target sequence. Such "alterations" include, for example: (i) replacement of at least one nucleotide, (ii) a deletion of at least one nucleotide, (iii) an insertion of at least one nucleotide, or (iv) any combination of (i)-(iii).

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments, one or more of the polynucleotides encoding the Cry toxin polypeptide(s) disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to: transgenes that confer resistance to an herbicide; transgenes that confer or contribute to an altered grain characteristic; genes that control male-sterility; genes that create a site for site specific dna integration; genes that affect abiotic stress resistance; genes that confer increased yield genes that confer plant digestibility; and transgenes that confer resistance to insects or disease.

Examples of transgenes that confer resistance to insects include genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Other non-limiting examples of *Bacillus thuringiensis* transgenes being genetically engineered are given in the following patents and patent applications: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin, (2011) *PLoS Pathogens*, 7:1-13), from *Pseudomonas protegens* strain CHA0 and Pf-5 (previously fluorescens) (Pechy-Tarr, (2008) *Environmental Microbiology* 10:2368-2386: GenBank Accession No. EU400157); from *Pseudomonas taiwanensis* (Liu, et al., (2010) *J. Agric. Food Chem.* 58:12343-12349) and from *Pseudomonas pseudoalcaligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. Nos. 6,048,838, and 6,379, 946; a PIP-1 polypeptide of U.S. Pat. No. 9,688,730; an AfIP-1A and/or AfIP-1B polypeptide of U.S. Pat. No. 9,475, 847; a PIP-47 polypeptide of US Publication Number US20160186204; an IPD045 polypeptide, an IPD064 polypeptide, an IPD074 polypeptide, an IPD075 polypeptide, and an IPD077 polypeptide of PCT Publication Number WO 2016/114973; an IPD080 polypeptide of PCT Serial Number PCT/US17/56517; an IPD078 polypeptide, an IPD084 polypeptide, an IPD085 polypeptide, an IPD086 polypeptide, an IPD087 polypeptide, an IPD088 polypeptide, and an IPD089 polypeptide of Serial Number PCT/US17/54160; PIP-72 polypeptide of US Patent Publication Number US20160366891; a PtIP-50 polypeptide and a PtIP-65 polypeptide of US Publication Number US20170166921; an IPD098 polypeptide, an IPD059 polypeptide, an IPD108 polypeptide, an IPD109 polypeptide of U.S. Ser. No. 62/521, 084; a PtIP-83 polypeptide of US Publication Number US20160347799; a PtIP-96 polypeptide of US Publication Number US20170233440; an IPD079 polypeptide of PCT Publication Number WO2017/23486; an IPD082 polypeptide of PCT Publication Number WO 2017/105987, an IPD090 polypeptide of Serial Number PCT/US17/30602, an IPD093 polypeptide of U.S. Ser. No. 62/434,020; an IPD103 polypeptide of Serial Number PCT/US17/39376; an IPD101 polypeptide of U.S. Ser. No. 62/438,179; an IPD121 polypeptide of US Serial Number U.S. 62/508,514, and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry28, Cry29, Cry30, Cry31, Cry32, Cry33, Cry34, Cry35, Cry36, Cry37, Cry38, Cry39, Cry40, Cry41, Cry42, Cry43, Cry44, Cry45, Cry46, Cry47, Cry49, Cry50, Cry51, Cry52, Cry53, Cry54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry72 classes of δ-endotoxin genes and the *B. thuringiensis* cytolytic Cyt1 and Cyt2 genes.

Examples of δ-endotoxins also include but are not limited to Cry1A proteins of U.S. Pat. Nos. 5,880,275 and 7,858, 849; a DIG-3 or DIG-11 toxin (N-terminal deletion of α-helix 1 and/or α-helix 2 variants of Cry proteins such as Cry1A) of U.S. Pat. No. 8,304,604 and 8.304,605, Cry1B of U.S. patent application Ser. No. 10/525,318; Cry1C of U.S. Pat. No. 6,033,874; Cry1F of U.S. Pat. Nos. 5,188,960; 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,378,499 and 7,462,760; a Cry9 protein such as such as members of the Cry9A, Cry9B, Cry9C, Cry9D, Cry9E, and Cry9F families; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein, a Cry51 protein, a Cry binary toxin; a TIC901 or related toxin; TIC807 of US 2008/0295207; ET29, ET37, TIC809, TIC810, TIC812, TIC127, TIC128 of PCT US 2006/033867; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230, and AXMI231 of WO11/103247; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US 2010/0005543; and Cry proteins such as Cry1A and Cry3A having modified proteolytic sites of U.S. Pat. No. 8,319,019; and a Cry1Ac, Cry2Aa and Cry1Ca toxin protein from *Bacillus thuringiensis* strain VBTS 2528 of US Patent Application Publication Number 2011/0064710. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to Cry1Ac, Cry1Ac+ Cry2Ab, Cry1Ab, Cry1A.105, Cry1F, Cry1Fa2, Cry1F+ Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

Further transgenes that confer resistance to insects may down-regulation of expression of target genes in insect pest species by interfering ribonucleic acid (RNA) molecules through RNA interference. RNA interference refers to the process of sequence-specific post-transcriptional gene silencing in animals mediated by short interfering RNAs (siRNAs) (Fire, et al., (1998) *Nature* 391:806). RNAi transgenes may include but are not limited to expression of dsRNA, siRNA, miRNA, iRNA, antisense RNA, or sense RNA molecules that down-regulate expression of target genes in insect pests. PCT Publication WO 2007/074405 describes methods of inhibiting expression of target genes in invertebrate pests including Colorado potato beetle. PCT Publication WO 2005/110068 describes methods of inhibiting expression of target genes in invertebrate pests including in particular Western corn rootworm as a means to control insect infestation. Furthermore, PCT Publication WO 2009/091864 describes compositions and methods for the suppression of target genes from insect pest species including pests from the *Lygus* genus.

RNAi transgenes are provided for targeting the vacuolar ATPase H subunit, useful for controlling a coleopteran pest population and infestation as described in US Patent Application Publication 2012/0198586. PCT Publication WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. PCT publication WO 2007/035650 describes ribonucleic acid (RNA or double stranded RNA) that inhibits or down regulates the expression of a target gene that encodes Snf7. US Patent Application publication 2011/0054007 describes polynucleotide silencing elements targeting RPS10. PCT publication WO 2016/205445 describes polynucleotide silencing elements that reduce fecundity, with target polynucleotides, including NCLB, MAEL, BOULE, and VgR. US Patent Application publication 2014/0275208 and US2015/0257389 describes polynucleotide silencing elements targeting RyanR and PAT3. PCT publications WO/2016/138106, WO 2016/060911, WO 2016/060912, WO 2016/060913, and WO 2016/060914 describe polynucleotide silencing elements targeting COPI coatomer subunit nucleic acid molecules that confer resistance to Coleopteran and Hemipteran pests. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describe potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1α Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Use in Pesticidal Control

General methods for employing strains comprising a nucleic acid sequence of the embodiments or a variant thereof, in pesticide control or in engineering other organisms as pesticidal agents are known in the art.

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene(s) expressing one or more of the Cry toxin polypeptides and desirably provide for improved protection of the pesticide from environmental degradation and inactivation.

Alternatively, the Cry toxin polypeptide is produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated Cry toxin polypeptides may then be formulated in accordance with conventional techniques for application to the environment hosting a target pest, e.g., soil, water, and foliage of plants. See, for example EPA 0192319, and the references cited therein.

Pesticidal Compositions

In some embodiments the active ingredients can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient or an agrochemical composition that contains at least one of the Cry toxin polypeptide(s) produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, Dipteran, Heteropteran, nematode, Hemiptera or Coleopteran pests may be killed or reduced in numbers in a given area by the methods of the disclosure or may be prophylactically applied to an environmental area to prevent infestation by a susceptible pest. Preferably the pest ingests or is contacted with, a pesticidally-effective amount of the polypeptide. "Pesticidally-effective amount" as used herein refers to an amount of the pesticide that is able to bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or other buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523. The plants can also be treated with one or more chemical compositions, including one or more herbicide, insecticides or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuriengiensis*, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethy)amino] furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Picoxystrobin, Pyraclostrobin, Cyflufenamid, Boscalid; Cereals Herbicides: Isoproturon, Bromoxynil, Ioxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethonmethyl, Pirimicarb, Methiocarb; Maize Herbicides: Atrazine, Alachlor, Bromoxynil, Acetochlor, Dicamba, Clopyralid, (S-) Dimethenamid, Glufosinate, Glyphosate, Isoxaflutole, (S-)Metolachlor, Mesotrione, Nicosulfuron, Primisulfuron, Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl] (2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl) methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-) Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino] furan-2 (5H)-on, Spirotetramat, Spinodiclofen, Triflumuron, Flonicamid, Thiodicarb, beta-Cyfluthrin; Soybean Fungicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluorethy)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl)amino]furan-2 (5H)-on.

In some embodiments the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinne or combinations thereof.

In some embodiments the insecticide is Esfenvalerate, Chlorantraniliprole, Methomyl, Indoxacarb, Oxamyl or combinations thereof.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, Lepidoptera, Mallophaga, Homoptera, Hemiptera Orthroptera, Thysanoptera, Dermaptera, Isoptera, Anoplura, Siphonaptera, Trichoptera, etc., particularly Lepidoptera and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order Lepidoptera include, but are not limited to, armyworms, cutworms, loopers and heliothines in the family Noctuidae *Spodoptera frugiperda* J E Smith (fall armyworm); *S. exigua* Hubner (beet armyworm); *S. litura fabricius* (tobacco cutworm, cluster caterpillar); *Mamestra configurata* Walker (bertha armyworm); *M brassicae linnaeus* (cabbage moth); *Agrotis Ipsilon* Hufnagel (black cutworm); *A. orthogonia* Morrison (western cutworm); *A. subterranea fabricius* (granulate cutworm); *Alabama argillacea* Hubner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra fabricius* (green cloverworm); *Heliothis virescens fabricius* (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella fabricius* (spotted bollworm); *Helicoverpa armigera* Hübner (American bollworm); *H. zea* Boddie (corn earworm or cotton bollworm); *Melanchra picta* Harris (zebra caterpillar); *Egira* (Xylomyges) *curialis* Grote (citrus cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata linnaeus* (melon worm); *D. nitidalis* Stoll (pickleworm); *Diatraea grandiosella* Dyar (southwestern corn borer), *D. saccharalis fabricius* (surgarcane borer); *Eoreuma loftini* Dyar (Mexican rice borer); *Ephestia elutella* Hübner (tobacco (cacao) moth); *Galleria mellonella linnaeus* (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella fabricius* (lesser wax moth); *Loxostege sticticalis linnaeus* (beet webworm); *Orthaga thyrisalis* Walker (tea tree web moth); *Maruca testulalis* Geyer (bean pod borer); *Plodia interpunctella* Hubner (Indian meal moth); *Scirpophaga incertulas* Walker (yellow stem borer); *Udea rubigalis* Guenée (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana linnaeus* (European leaf roller); and other *Archips* species, *Adoxophyes orana* Fischer von Rösslerstamm (summer fruit tortrix moth); *Cochylis hospes* Walsingham (banded sunflower moth); *Cydia latiferreana* Walsingham (filbertworm); *C. pomonella linnaeus* (coding moth); *Platynota flavedana* Clemens (variegated leafroller); *P. stultana* Walsingham (omnivorous leafroller); *Lobesia botrana* Denis & Schiffermüller (European grape vine moth); *Spilonota ocellana* Denis & Schiffermüller (eyespotted bud moth); *Endopiza viteana* Clemens (grape berry moth); *Eupoecilia ambiguella* Hubner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order Lepidoptera include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Méneville (Chinese Oak Tussah Moth); *Bombyx mori linnaeus* (Silkworm); *Bucculatrix thurberiella* Busck (cotton leaf perforator); *Colias eurytheme* Boisduval (alfalfa caterpillar); *Datana integerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea linnaeus* (browntail moth); *Harrisina americana* Guérin-Méneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis linnaeus* (satin moth); *Lymantria dispar linnaeus* (gypsy moth); *Manduca quinquemaculata* Haworth (five spotted hawk moth, tomato hornworm); *M. sexta* Haworth (tomato hornworm, tobacco hornworm); *Operophtera brumata linnaeus* (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella fabricius* (spotted tentiform leafminer); *Pieris brassicae linnaeus* (large white butterfly); *P. rapae linnaeus* (small white butterfly); *P. napi linnaeus* (green veined white butterfly); *Platyptilia carduidactyla* Riley (artichoke plume moth); *Plutella xylostella linnaeus* (diamondback moth); *Pectinophora gossypiella* Saunders (pink bollworm); *Pontia protodice* Boisduval and Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta*

*absoluta* Meyrick (tomato leafminer); *Yponomeuta padella linnaeus* (ermine moth); *Heliothis subflexa* Guenee; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius linnaeus* (granary weevil); *S. oryzae linnaeus* (rice weevil); *Hypera punctata fabricius* (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea fabricius* (grape colaspis); *Oulema melanopus linnaeus* (cereal leaf beetle); *Zygogramma exclamationis fabricius* (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle)); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica linnaeus* (house flies); *Fannia canicularis linnaeus, F. femoralis* Stein (lesser house flies); *Stomoxys calcitrans linnaeus* (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus linnaeus* (keds) and other *Brachycera*, mosquitoes *Aedes* spp.; *Anopheles* spp.; *Culex* spp.; black flies *Prosimulium* spp.; *Simulium* spp.; biting midges, sand flies, sciarids, and other *Nematocera*.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, phylloxera from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae scopoli* (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae linnaeus* (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi linnaeus* (bird cherry-oat aphid); *Schizaphis graminum* Rondani (greenbug); *Sipha flava* Forbes (yellow sugarcane aphid); *Sitobion avenae fabricius* (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Adelges* spp. (adelgids); *Phylloxera devastatrix* Pergande (pecan phylloxera); *Bemisia tabaci gennadius* (tobacco whitefly, sweetpotato whitefly); *B. argentifolii* Bellows & Perring (silverleaf whitefly); *Dialeurodes citri* Ashmead (citrus whitefly); *Trialeurodes abuhloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrihneatus* Forbes (aster leafhopper); *Nephotettix cinticeps* Uhler (green leafhopper); *N nigropictus* Stål (rice leafhopper); *Nilaparvata lugens* Stål (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim linnaeus* (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear psylla); *Trioza diospyri* Ashmead (persimmon psylla).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii fabricius* (cotton lace bug); *Cyrtopeltis modesta* Distant (tomato bug); *Dysdercus suturellus* Herrich-Schäffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis linnaeus* (common meadow bug); *L. ruguhpennis* Poppius (European tarnished plant bug); *Lygocoris pabulinus* Linnaeus (common green capsid); *Nezara viridula linnaeus* (southern green stink bug); *Oebalus pugnax fabricius* (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris linnaeus; Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus fabricius* (four-lined plant bug); *Nysius ericae* Schilling (false chinch bug); *Nysius raphanus* Howard (false chinch bug); *Nezara viridula linnaeus* (Southern green stink bug); *Eurygaster* spp.; Coreidae spp.; Pyrrhocoridae spp.; Tinidae spp.; Blostomatidae spp.; Reduviidae spp. and Cimicidae spp.

Also included are adults and larvae of the order Acari (mites) such as *Aceria tosichella* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T mcdanieli* McGregor (McDaniel mite); *T cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes* scapular's Say (deer tick); *I. holocyclus* Neumann (Australian paralysis tick); *Dermacentor variabilis* Say (American dog tick); *Amblyomma americanum linnaeus* (lone star tick) and scab and itch mites in the families Psoroptidae, Pyemotidae and Sarcoptidae.

Insect pests of the order Thysanura are of interest, such as *Lepisma saccharina linnaeus* (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans fabricius* (black widow spider) and centipedes in the order Scutigeromorpha such as *Scutigera coleoptrata linnaeus* (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus,* and *Bagrada hilaris* (Bagrada Bug)), the family Plataspidae (*Megacopta cribraria*—Bean plataspid) and the family Cydnidae (*Scaptocoris castanea*-Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743, 477. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C. D. S. Tomlin Ed., Published by the British Crop Production Council.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of *cereus, firmus, megaterium, pumilis, sphaericus, subtilis* and/or *thuringiensis* species), *bradyrhizobium* spp. (including one or more of *betae, canariense, elkanii, iriomotense, japonicum*, liaonigense, *pachyrhizi* and/or *yuanmingense*), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, penicillium, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, trichoderma, trifloxystrobin, triticonazole and/or zinc. PCNB seed coat refers to EPA Registration Number 00293500419, containing quintozen and terrazole. TCMTB refers to 2-(thiocyanomethylthio) benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest, either simultaneously or sequentially, with an insecticidally-effective amount of a recombinant Cry toxin polypeptide of the disclosure. In some embodiments methods are provided for killing an insect pest, comprising contacting the insect pest with an insecticidally-effective amount of one or more of a recombinant pesticidal protein of SEQ ID NOS: 57-112, 214-246, and 275-278, or a variant or insecticidally active fragment thereof.

In some embodiments methods are provided for controlling an insect pest population, comprising contacting the insect pest population, either simultaneously or sequentially, with an insecticidally-effective amount of one or more of a recombinant Cry toxin polypeptide of the disclosure. In some embodiments, methods are provided for controlling an insect pest population, comprising contacting the insect pest population with an insecticidally-effective amount of one or more of a recombinant Cry toxin polypeptide of SEQ ID NOS: 57-112, 214-246, and 275-278, or a variant or insecticidally active fragment thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population, either simultaneously or sequentially, with an insecticidally-effective amount of one or more of a recombinant Cry toxin polypeptide of the disclosure. In some embodiments, methods are provided for controlling an insect pest population resistant to a pesticidal protein, comprising contacting the insect pest population with an insecticidally-effective amount of one or more of a recombinant Cry toxin polypeptide of SEQ ID NOS: 57-112, 214-246, and 275-278, or a variant or insecticidally active fragment thereof.

In some embodiments methods are provided for protecting a plant from an insect pest, comprising expressing in the plant or cell thereof at least one recombinant polynucleotide encoding a Cry toxin polypeptide of the disclosure. In some embodiments methods are provided for protecting a plant from an insect pest, comprising expressing in the plant or cell thereof a recombinant polynucleotide encoding one or more Cry toxin polypeptides of SEQ ID NOS: 57-112, 214-246, and 275-278, or variants or insecticidally active fragments thereof.

Insect Resistance Management (IRM) Strategies

Expression of *B. thuringiensis* δ-endotoxins in transgenic corn plants has proven to be an effective means of controlling agriculturally important insect pests (Perlak, et al., 1990; 1993). However, in certain instances insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way of increasing the effectiveness of the transgenic insecticides against target pests and contemporaneously reducing the development of insecticide-resistant pests is to use non-transgenic (i.e., non-insecticidal protein) refuges (a section of non-insecticidal crops/corn) with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the Cry toxin polypeptides of the disclosure are useful as an insect resistance management strategy in combination (i.e., pyramided) with other pesticidal proteins or other transgenes (i.e., an RNAi trait) including but not limited to Bt toxins, *Xenorhabdus* sp. or *Photorhabdus* sp. insecticidal proteins, other insecticidally active proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments the methods of controlling Lepidoptera and/or Coleoptera insect infestation in a transgenic plant and promoting insect resistance management comprises the presentation of at least one of the Cry toxin polypeptide insecticidal proteins to insects in the order Lepidoptera and/or Coleoptera.

In some embodiments the methods of controlling Lepidoptera and/or Coleoptera insect infestation in a transgenic plant and promoting insect resistance management comprises the presentation of at least one of the Cry toxin polypeptides of SEQ ID NOS: 57-112, 214-246, and 275-278, or variants or insecticidally active fragments thereof, insecticidal to insects in the order Lepidoptera and/or Coleoptera.

Also provided are methods of reducing likelihood of emergence of Lepidoptera and/or Coleoptera insect resistance to transgenic plants expressing in the plants insecticidal proteins to control the insect species, comprising expression of at least one of a Cry toxin polypeptide insecticidal to the insect species in combination with a second insecticidal protein to the insect species having different modes of action.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant. "Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing at least one Cry toxin polypeptide disclosed herein. Expression of the Cry toxin polypeptide(s) results in a reduced ability of a pest to infest or feed on the plant, thus improving plant yield.

Methods of Processing

Further provided are methods of processing a plant, plant part or seed to obtain a food or feed product from a plant, plant part or seed comprising at least one Cry toxin polynucleotide. The plants, plant parts or seeds provided herein, can be processed to yield oil, protein products and/or by-products that are derivatives obtained by processing that have commercial value. Non-limiting examples include transgenic seeds comprising a nucleic acid molecule encoding one or more Cry toxin polypeptides which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXAMPLES

Example 1: Synthesis of Various Cry Toxin Domain Fragments

Whole domain fragments (Dm 1, Dm2 and Dm3) of 42 holotype Cry toxins were optimized for *E. coli* expression and synthesized (See FIG. 1). All domain fragments were cloned into pUC19 sub cloning for expression. These fragments were used as starting materials for many of block shuffling libraries. All holotype Cry toxin protein information was obtained from NCBI Gen Bank, Crickmore, et al., "*Bacillus thuringiensis* toxin nomenclature" (2011), at life-sci.sussex.ac.uk/home/Neil_Crickmore/Bt/which can be accessed on the world-wide web using the "www" prefix, and btnomenclature.info/which can be accessed on the world-wide web using the "www" prefix. Table 1 lists holotype toxin fragments that were synthesized.

TABLE 1

Holotype Bt Toxin Synthesized Fragments
List of Cry1 and Cry9 holotype (WT) synthesized as domain fragments Cry1Aa
Cry1Ab
Cry1Ac
Cry1Ad
Cry1Ae
Cry1Af
Cry1Ag
Cry1Ah
Cry1Ai
Cry1Ba
Cry1Bb
Cry1Bd
Cry1Be
Cry1Bf
Cry1Bg
Cry1Bh
Cry1Ca
Cry1Cb
Cry1Da
Cry1Db
Cry1Dc
Cry1Ea
Cry1Eb
Cry1Fa
Cry1Fb
Cry1Ga
Cry1Gb
Cry1Gc
Cry1Ha
Cry1Hb
Cry1Ia
Cry1Ib
Cry1Ic
Cry1Id
Cry1Ie
Cry1If
Cry1Ka
Cry1La
Cry1Ma TABLE 1-continued

| Holotype Bt Toxin Synthesized Fragments<br>List of Cry1 and Cry9 holotype (WT) synthesized as domain fragments |
|---|
| Cry9Aa |
| Cry9Ba |
| Cry9Bb |
| Cry9Ca |
| Cry9Da |
| Cry9Db |
| Cry9Ea |
| Cry9Eb |
| Cry9Ec |
| Cry9Ed |

Example 2: Vector Insert and Backbone Assembly

PCR products for the inserts (Domain 1, 2, or 3, or sub domain fragments) were amplified using Q5 High-Fidelity DNA Polymerase (NEB M0491L), while plasmid backbones were amplified using Phusion High-Fidelity DNA Polymerase (ThermoFisher F530L or NEB M0530L), following the instructions for recommended temperatures and cycles in the respective DNA polymerase's protocol.

All libraries were cloned into pMAL vector pVER6805 to be expressed as His-MBP-toxin configuration. Following production of the insert (Dm1, 2 and 3) PCR fragments, the vector backbone (8 to 9 kb in length excluding the insert portion) containing His+MBP and additional essential vector elements were produced by inverse PCR.

Inserts and backbones were assembled into plasmids primarily with NEBuilder HiFi DNA Assembly Master Mix (NEB E2621L), using 10 ul reactions, which were scaled down from the original 20 ul protocol, and following the recommended incubation temperature and length.

NEBuilder assembly reactions were diluted 1:2 with deionized water and 1 ul was used in the transformation of 50 ul of electro competent BL21(DE3) cells (Lucigen E. cloni EXPRESS 60300-2) diluted 1:8. Alternatively, the GeneArt Seamless Cloning and Assembly Kit (Invitrogen A13288) was occasionally used for the assembly of inserts and backbones, following the directions for the reaction. For the transformation, 10 ul of the reaction was added to 50 ul of Invitrogen One Shot Chemically Competent TOP10 cells (included with the kit). Cultures were grown and plasmid DNA was prepared using a Miniprep Kit (Qiagen 27104). The plasmid DNA was then used to transform 50 ul of chemically competent BL21-Gold (DE3) cells (Agilent 230132).

BL21 cells were plated onto LB agar plates with carbenicillin selection at 100 ug/ml and grown overnight at 37 C. Starter cultures of 150-160 ul LB carb (100 ug/ml) were inoculated and grown overnight, shaking at 37 C. Magic Media cultures (Invitrogen K6803) were grown in deep-well plate format with 1 ml of Magic Media inoculated with 20 ul of starter culture. The Magic Media plates were cultured at 25 C for 8 hours, then 16 C for 64 hours, shaking at 250 rpm. The plates were spun at 4000 rpm for 15 minutes. The supernatant was discarded, a steel ball was added to each well and the plates were stored at −80 C overnight.

The plates were vortexed until the cell pellets were re-suspended and then shaken 250 rpm at 37 C for 1.5 to 2 hours. After storage at −80 C overnight, the plates were thawed and the steel balls removed with a large magnet, followed by a spin at 4000 rpm for 20 minutes at 4 C.

To prepare the samples for Western analysis, 7.5 ul of supernatant plus 7.5 ul of deionized water were combined with 5 ul of E-PAGE sample loading buffer (included with Invitrogen E-PAGE 96-well 6% gels EP09606) with 4% beta mercaptoethanol added. The samples were heated 70 C for 10 minutes and spun for 5 min at 4000 rpm at 4 C. A 96-well E-PAGE gel was then loaded with 5 ul of samples plus 15 ul of deionized water, along with 5 ul of E-PAGE See Blue Pre-Stained Standard (Invitrogen LC5700) plus 15 ul of deionized water. The gel was run on program EP of the E-Base gel device (Invitrogen EBM03 and EBD03) for 20 minutes.

The iBlot2 system (Invitrogen IB21001) was used to transfer the proteins from the gel to a nitrocellulose membrane (Invitrogen IB23001) according to the manufacturer's directions. The membrane was blocked with SuperBlock T20 (TBS) Blocking Buffer (ThermoFisher 37536) for an hour at room temperature and then incubated overnight at 4 C with Sigma Monoclonal Anti-Maltose Binding Protein-Alkaline Phosphatase antibody produced in mouse (A3963-5ML) diluted 1:2000 in SuperBlock T20. After 3 10-minute washes with TBS-T (0.05% Tween-20), the blots were developed with Bio-Rad Alkaline Phosphatase Conjugate Substrate Kit (170-6432) according to the manufacturer's protocol. Proteins that appeared to have good expression profiles were then advanced to screening by insect assay.

For production of the proteins that were advanced after expression screening, glycerol stocks were stamped onto LB carb (100 ug/ml) and incubated at 30 C or 37 C overnight. Colonies from these plates were used to inoculate 3 ml LB carb (100 ug/ml) starter cultures grown 37 C overnight. Magic Media cultures (Invitrogen K6803) of 100 ml to 200 ml were inoculated with 1 ml to 2 ml starter cultures, respectively (i.e., 1% of final volume) and shaken 25 C for 8 hours, then 16 C for 64 hours at 250 rpm. The cultures were spun down at 9000 rpm 10 min 4 C.

Shuffled insecticidal proteins ("IPRS" polypeptides or proteins) were expressed in a modified pMAL vector (Cat #E8000S from New England Biolabs) as a fusion with MBP (maltose binding protein). The pMAL vector was modified to attach a 6× His tag to the N-terminal end of MBP after methionine at position 1. The plasmid containing the insecticidal protein gene was cloned in *E. coli* BL21 (DE3). The BL21 cells were grown in MagicMedia™ (Life Technologies) in either 96 deep well plates or flasks in a shaker running at 250 rpm at 37° C. for 8 hrs followed by 16° C. for 64 hrs. During the 16° C. incubation, the MBP-toxin fusion protein was accumulated in the BL21 cell as a soluble protein.

In order to purify the fusion protein, the *E. coli* cells were harvested by centrifugation and treated in a lysozyme solution consisting of 2 mg/ml lysozyme in 50 ml sodium phosphate buffer at pH8 containing 300 mM NaCl, 2 U/ml endonuclease (Epicentre) and 5 mM MaCl2 for 3 hrs at 37° C. with gentle shaking. The lysozyme treated *E. coli* cells were then disrupted with 1% Triton X100 and clear lysate containing the toxins were prepared by centrifugation at 4000 rpm, 30 min (96 well plates) or 9000 rpm (flask produced samples). His tagged MBP-toxin proteins were purified from the clear lysate by affinity chromatography using NiNTA agarose from Qiagen™ following the manufacturer's standard procedure. For those clear lysate samples made in 96 well plates, Pall Corporation™ (25 Harbor Park Drive Port Washington, N.Y. 11050) 96 deep well filter plates were used as affinity chromatography columns. The purified toxin proteins eluted from NiNTA agarose was passed through Sephadex G25 to change the phosphate buffer to 25 mM HEPES-NaOH, pH8 and used in insect bioassay for determining the insecticidal. MBP was digested with 1/100 (w/w) Factor Xa (New England Biolabs) at 25° C. for overnight and removed from the toxins by Superdex 200 column chromatography utilizing the size difference and a weak affinity of MBP to Superdex.

Protein concentrations were determined by capillary electrophoresis with the LabChip™ GXII device (Caliper LifeSciences). The protein analysis was repeated at least 3 times until the final concentrations were considered to be reliable within the predetermined deviation, less than 10%.

The activity of IPRS polypeptide variants against major corn pests, European Corn Borer (ECB, *Ostrinia nubilalis*), Corn Earworm (ECW, *Helicoverpa zea*) and Fall Armyworm (FAW, *Spodoptera frugiperda*), was determined by feeding assay as described by Cong, R., et al. Proceedings of the 4th Pacific Rim Conferences on Biotechnology of *Bacillus thuringiensis* and its environmental impact, pp. 118-123, ed. by R. J. Akhurst, C. E. Beard and P. Hughes, published in 2002, Canberra, Australia. Briefly, the assays were conducted on an artificial diet containing the insecticidal proteins. The insecticidal proteins were prepared as described in Example 1, and 10 µL of protein samples were mixed with 40 µL of molten (40-50° C.) artificial insect diet prepared based on Southland Premix formulated for Lepidopteran insects (Southland Products, Lake Village, Ark.) with low temperature melting agarose. The diet—insecticidal protein mixture was placed in each well of a 96 well micro-titer plate. One or more neonate insect larvae were placed in each well to feed for 4 days for CEW and FAW and 5 days for ECB at 28° C.

Example 3: Cry1J Alpha Loop 3-5 Shuffling (for IPRS Hits C21 and C51)

Figure 5:
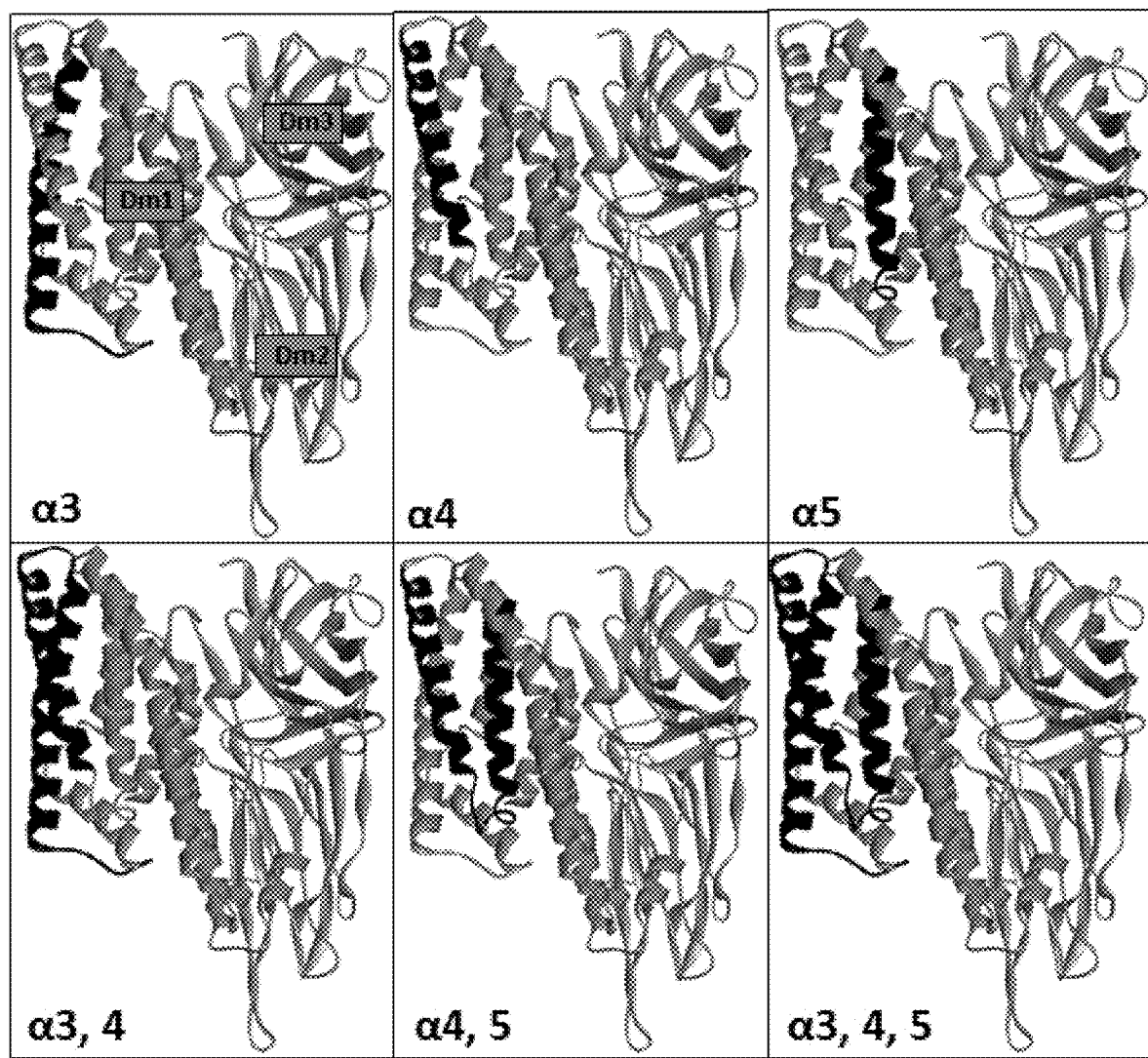
FIG. 5 shows a homology model of IPRS-C16 with different domains labeled. Shuffled alpha helices (both individual and combinations) are indicated in black and the remainder of the protein (rest of the Dm1, Dm2 and Dm3) is colored in gray. Alpha shuffling was done in IPRS-C16 and IPRS-C21.
Figure 6:
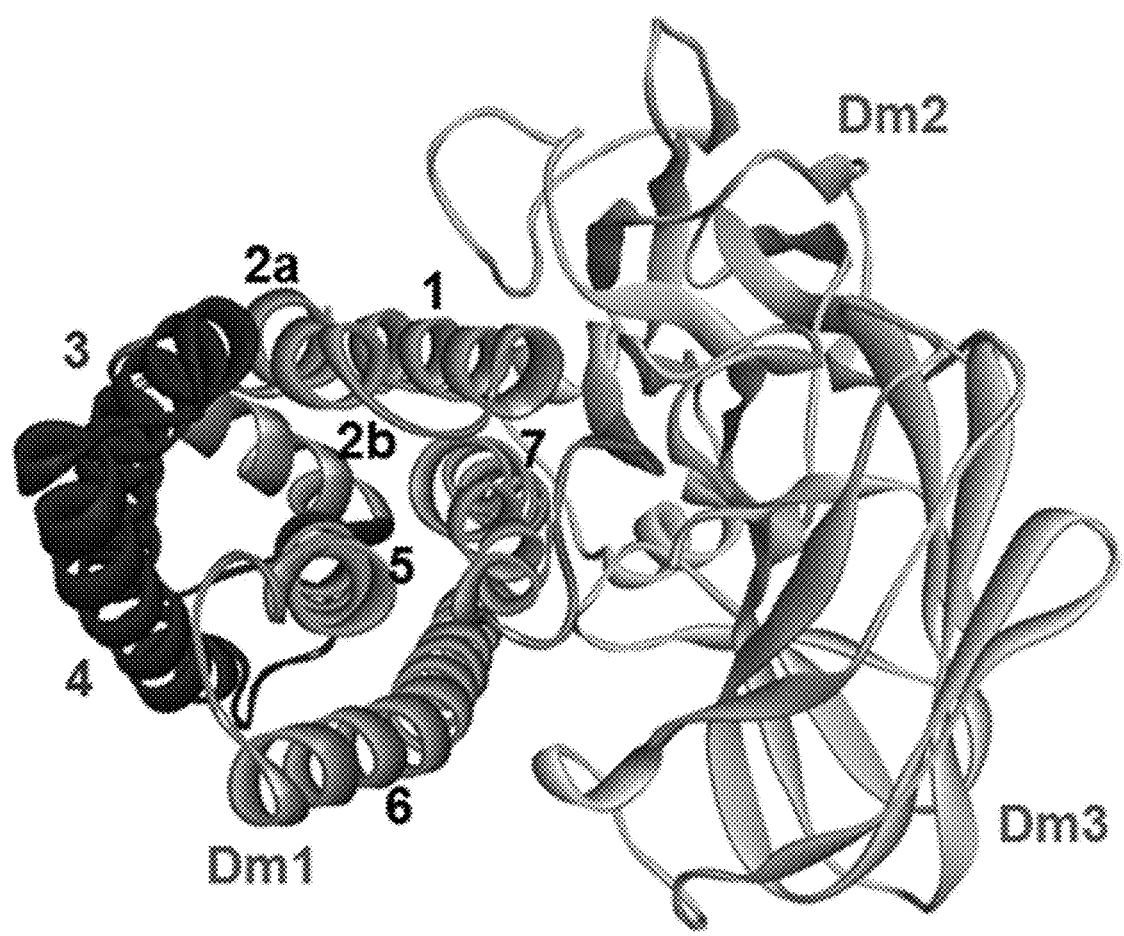
FIG. 6 shows a homology model (top view image) of IPRS-C16 showing the shuffled fragment of Dm1 (Alpha-3, Alpha-4 and part of Alpha-5 fragment) colored in black. Different alpha helices and domains are labeled. Location of helices was determined based on alignment of multiple Cry toxins and X-ray structural information of known Cry toxins.
Figure 9:
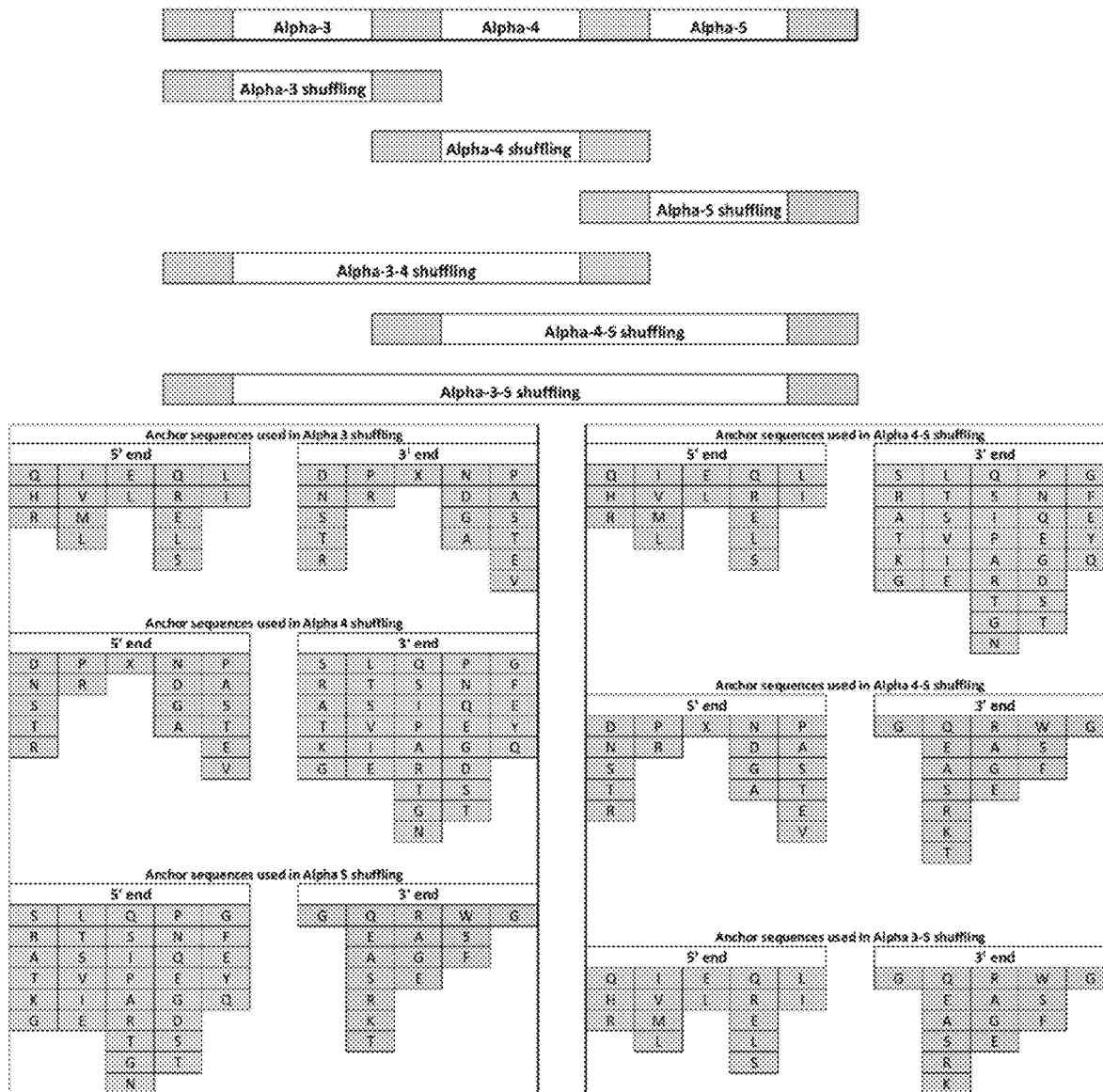
FIG. 9 shows fragments of Dm1 (Alpha loops 3, 4, 5, 3-4, 4-5, and 3-5) shuffled as described in the Examples. Shaded areas are anchor sequences where the shuffled fragment was fused to the backbone. Usually, the 5' anchor sequence motifs are QIEQL (SEQ ID NO: 247, for shuffling of alpha helix-3, 4&5 and 3&5), DPXNP (SEQ ID NO: 248, for shuffling alpha-4, 4&5) and SLQPG (SEQ ID NO: 249, for shuffling alpha-5). 3' anchor sequence motifs are DPXNP (SEQ ID NO: 248, for shuffling of alpha-3), SLQPG (SEQ ID NO: 249, for shuffling alpha-3&4) and GQRWG (SEQ ID NO: 268, for shuffling alpha-5, 4&5 and 3&5). Diversity at each of these anchor sequence positions was also listed below the normal anchor sequence motif in columns.

Whole domain 1 (Dm1) shuffling often resulted in very low soluble expression. Instead, data suggests the region encompassing alpha loops 3 to 5 of Dm has 1) minimal interaction with rest of the protein; and, 2) is exposed to solvent, was shuffled (See Tables 2, 3, and 10, and FIGS. 5 and 6). Therefore, shuffling of alpha loop 3-5 regions were predicted to have an impact on solubility of the shuffled polypeptides, as well as potentially altering insectidal activities. As a proof of concept library, two small libraries were made. In each library, the alpha loop 3-5 region of Cry1Jc and Cry1Ja was swapped with both the Cry1Ca and Cry1Ah Alpha loop 3-5 regions. The consensus region between QIEQL (SEQ ID NO: 247, at the end of alpha loop 2B) and ANLHL (SEQ ID NO: 251, in the middle of alpha loop 5) of the Dm1 was selected to shuffle. These five amino acid stretches (SEQ ID NOs: 247 and 251) are highly conserved among several Cry1 toxins (See FIGS. 8 and 9). Consensus regions between alpha loops 3 and 4 (SEQ ID NO: 248), and alpha loops 4 and 5 (SEQ ID NO: 249) were also identified for potential chimeric alpha loop swapping. In addition to Alpha loop 3-5 swapping, Domain 3 of Cry1Jc and Cry1Ja was also swapped with Domain 3 of Cry1Ac and Cry1Ca (see FIGS. 8 and 9). Total library size was 6 with 12 constructs in total for two backbones (See FIG. 2). All 12 constructs for the library were synthesized as described in Example 2. Alpha loop 3-5 amino acid sequence regions of various Cry toxins used in shuffling are set forth in SEQ ID NOs: 159-180 (encoded by DNA sequences as set forth in SEQ ID NOs: 137-158, respectively).

In order to express these genes as MBP-fusion proteins, they were cloned into pMal vector. Toxin sequences were PCR amplified from pUC19 vectors. Vector backbone was obtained by inverse PCR pMal vector. Then, both insert and vector backbones were ligated using homology based cloning kit Geneart and NEBuilder. These twelve clones were transformed into BL21 *E. Coli* cells and proceeded for protein purification directly without checking for expression.

Proteins were purified, quantified and submitted for insect assay against CEW and FAW. Initial testing was done for a Yes/No assay to assess activity. Based on initial results, selected clones were submitted for a dose response assay for specific activity. Later, the active clone(s) were tested for their activity against other lepidopteran pests (SBL, VBC and ECB) to determine their activity spectrum (See Table 2).

TABLE 2

Activity spectrum of active clones

| SEQ ID | Variant | Toxin Composition Dm1 | | | | | Activity (ppm) | | | | | |
|---|---|---|---|---|---|---|---|---|---|---|---|---|
| | | | | | | | CEW | | FAW | | ECB | SBL | VBC |
| NO: | name | α1-2 | α3-5 | α6-7 | Dm2 | Dm3 | IC50 | LC50 | IC50 | LC50 | ILC50 | ILC50 | ILC50 |
| 88 | IPRS-C21 | Jc | Ca | Jc | Jc | Jc | 1.34 | 19.88 | N.A | | 1.91 | <1 | ~4000 |
| 87 | IPRS-C51 | Ja | Ca | Ja | Jc | Ja | N.A | | 376.73 | N.M | N.D | | |

*N.A. means not active as tested; N.M. means no mortality as tested; and N.D. means not determined Example 4: Dm1 Alpha Loop 3-5 and Dm3 Shuffling on Cry1Ea Backbone for IPRS Hits: IPRS-C13. IPRS-14, IPRS-15, IPRS-16, IPRS-17, IPRS-19 and IPRS-31

Based on the success of alpha loop 3-5 library of 1Jc backbone, a library was designed to shuffle several hybrid domain 1 (Dm1) domains with Cry1Ea domain 2 (Dm2) and Cry1Ca domain 3 (Dm3) at three different cross over points having different lengths of hybrid domain 3. The hybrid Dm1s are similar to each other, except at alpha 3-5 region. Along with 9 hybrid Dm1s, three Cry1Ea-like Dm1s were also used in shuffling.

Eleven Dm1s (Two Cry1Ea-like Dm1s and 9 hybrid Dm1s) and three Cry1Ea Dm2-Cry1Ca Dm3 fragments (Cry1Ea Dm2 and Cry1Ca Dm3 fused at three different crossover points) were synthesized. Three libraries (ECF2, 3 and 4) were constructed (See FIG. 3). In the ECF2 library, 11 Dm1s were shuffled with Cry1Ea Dm2 and Cry1Ca Dm3. Cry1Ea Dm2 was fused with Cry1Ca Dm3 at crossover region 1 in Dm3 (SEQ ID NO: 251). In the ECF3 library, 11 Dm1s were shuffled with Cry1Ea Dm2 and Cry1Ca Dm3. Cry1Ea Dm2 was fused with Cry1Ca Dm3 at consensus crossover region 2 in Dm3 (SEQ ID NO: 252). In the ECF4 library, 11 Dm1s were shuffled with Cry1Ea Dm2 and Cry1Ca Dm3. Cry1Ea Dm2 was fused with Cry1Ca Dm3 at consensus crossover region 3 in Dm3 (SEQ ID NO: 253).

In order to express these genes as MBP-fusion proteins, all three libraries were made in pMal vector. The Dm1s and three Dm2-Dm3 fragments were PCR amplified from pUC19 vectors. Vector backbone was obtained by inverse PCR of pMal vector backbone. Then, both insert (Dm 1, Dm2-Dm2) and vector backbones were assembled using homology based cloning kit Geneart and NEBuilder.

All 33 clones (11 clones/library) were sequence confirmed and transformed into BL21 *E. coli* cells and checked for expression using western blot. All 22 clones that were expressed grown in 200 ml cultures and proteins were purified, quantified and submitted for insect assay against FAW. Selected clones based on initial testing results were submitted for a dose response assay to get specific activity. Later, the most active clone under test conditions (IPRS-C16, SEQ ID NO: 62) was tested for its activity against other lepidopteran pests (SBL, VBC and ECB), along with certain other clones, to determine their activity spectra (See Tables 3 and 4).

Figure 4:
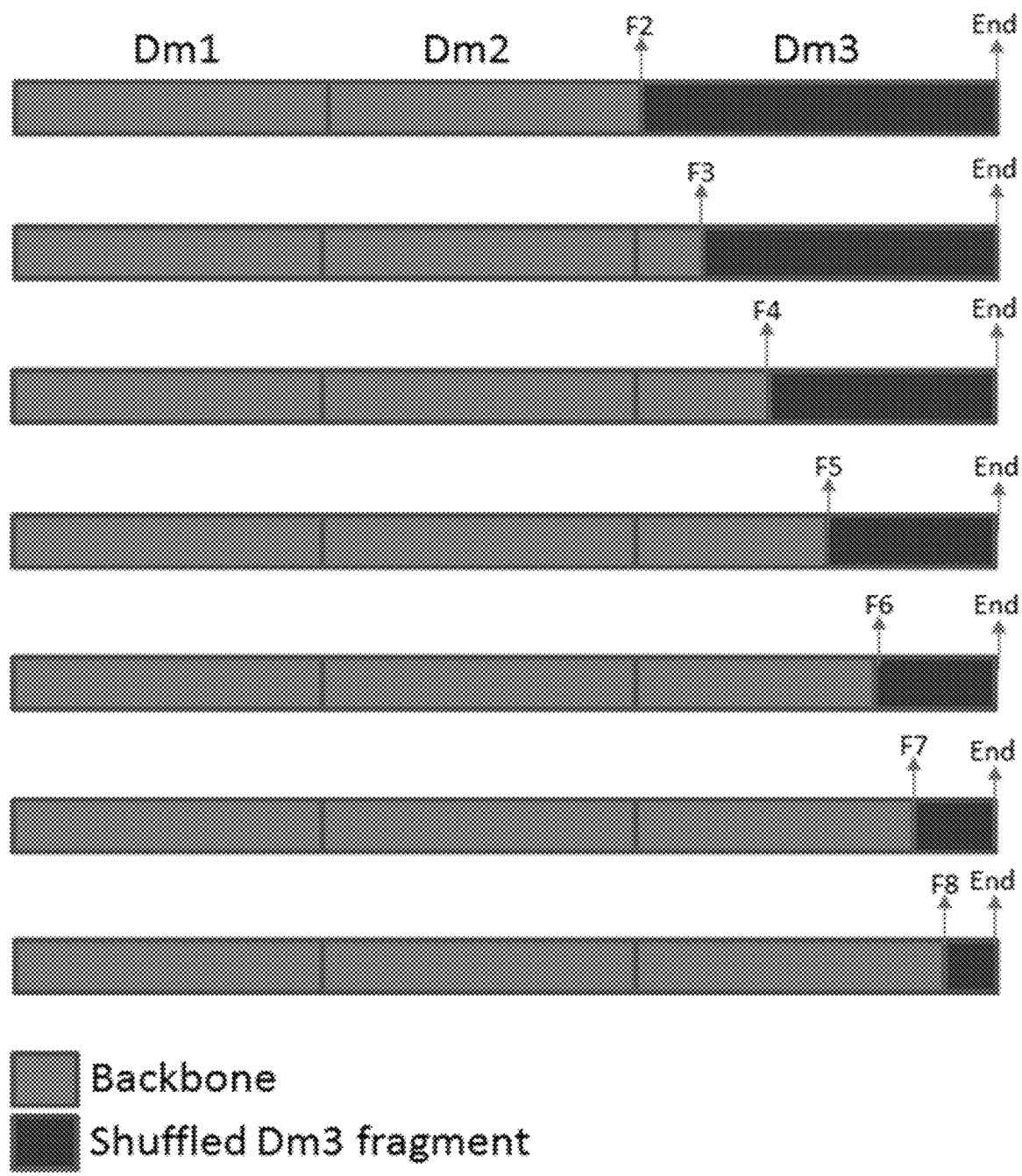
FIG. 4 shows a representation of an alignment of several Cry toxins with seven different cross over regions between Dm2 and Dm3 or just within Dm3, which are used as recombination sites for Dm3 fusions on C16, C18 and C21 Dm1-Dm2 backbones. Dm3 shuffling was done by fusing Dm3s to Dm1-Dm2 backbone at different crossover (fusion) points. Crossover points are labeled as F2 to F8 (SEQ ID NOs: 251-257).

53 different synthesized Cry toxin domain-3s were selected as sources of diversity. Seven fragments (crossover consensus regions 1-7, SEQ ID NOs: 251-257; See Table 5 and FIG. 4) of each domain were PCR amplified and pooled based on crossover point (each pool containing 53 PCR fragments). Two sets of Dm3 PCR fragment pools, each set containing 7 individual Dm3 fragments pools, were made. One set was made for IPRS-C21 backbone and another set for IPRS-C16 and IPRS-C18 backbones. Corresponding pools forming each set are identical except for cross over region homology (FIG. 4).

Seven (crossovers 1-7, also named F2-F8 respectively) vector backbones were made by inverse PCR of backbone excluding the region to be swapped using backbone specific PCR primers. Since IPRS-C16 and IPRS-C18 have identical Dm3s, common primers were used for these two backbones.

TABLE 3

Activity spectrum of shuffled clones

| SEQ ID NO: | Variant name | Toxin Composition | | | | | Activity (ppm) | | | | | | | | |
|---|---|---|---|---|---|---|---|---|---|---|---|---|---|---|---|
| | | Dm1 | | | Dm2 | Dm3 | CEW | | FAW | | ECB | | SBL | | VBC | |
| | | α1-2 | α3-5 | α6-7 | | | IC50 | LC50 | IC50 | LC50 | ILC50 | LC50 | ILC50 | LC50 | ILC50 | LC50 |
| 59 | C13 | 1Ea | Aa | 1Ea | 1Ea | 1Ca | N.A. | N.A. | 3.4 | 63 | N.A. | N.A. | <3 | <3 | <1 | 16 |
| 60 | C14 | 1Ea | Ab | 1Ea | 1Ea | 1Ca | N.D. | N.D. | 4.52 | 185 | N.D. | N.D. | N.D. | N.D. | N.D. | N.D. |
| 61 | C15 | 1Ea | Eb | 1Ea | 1Ea | 1Ca | N.D. | N.D. | 5.06 | 168 | N.D. | N.D. | N.D. | N.D. | N.D. | N.D. |
| 62 | C16 | 1Ea | MP294 | 1Ea | 1Ea | 1Ca | N.A. | N.A. | <1 | 25 | N.A. | N.A. | <3 | <3 | <1 | 4 |
| 63 | C17 | 1Ea | Ad | 1Ea | 1Ea | 1Ca | N.A. | N.A. | 4 | 69 | N.A. | N.A. | <2 | <2 | <1 | 4.5 |
| 64 | C19 | 1Ea | MP294 | 1Ea | 1Ea | 1Ca | N.D. | N.D. | 35 | 282 | N.D. | N.D. | N.D. | N.D. | N.D. | N.D. |
| 65 | C31 | 1Ea | Eb | 1Ea | 1Ea | 1Ca | N.D. | N.D. | 333 | N.M. | N.D. | N.D. | N.D. | N.D. | N.D. | N.D. |

*N.A. means not active as tested; and N.D. means not determined

Example 5: Dm3 Fragment Shuffling on C16 and C21

Domain 3 (Dm3) is believed to be involved in secondary receptor recognition. Therefore, Dm3 shuffling was done on IPRS-C16 (SEQ ID NO: 62), IPRS-C18 (SEQ ID NO: 66), and IPRS-C21 (SEQ ID NO: 88) to generate unique variants and potentially having different sites of action (SOA). Based on the alignment of several Cry toxins, seven different crossover regions between Dm2 and Dm3, which are generally conserved, were used as recombination sites for Dm3 fusion on IPRS-C16, IPRS-C18 and IPRS-C21 Dm1-Dm2 backbones.

Each specific Dm3 pool was assembled with corresponding inverse PCR Vector backbone to obtain all variants in pMal vector backbone to be expressed as MBP fusion proteins. All variants were re-arrayed after sequence confirmation. Only those clones that were expressed in soluble fraction in *E. coli* were further purified and tested for their insect activity. IPRS-C16 and IPRS-C18 Dm3 variants were initially screened against FAW and IPRS-C21 variants were screened against CEW. Active variants were further tested for their activity spectrum on other lepidopteran pests (See Table 4 and FIG. 7). The Dm3 variants retained activity but, had decreased activity as tested against their respective target insect (IPRS-C16 and IPRS-C18: FAW, IPRS-C21: CEW) compared their parents.

TABLE 4

Dm3 swapping activity spectrum on other Lepidopteran pests

| SEQ ID NO: | Variant name | Toxin Composition | | | | | Activity (ppm) | | | | | | | | |
|---|---|---|---|---|---|---|---|---|---|---|---|---|---|---|---|
| | | Dm1 | | | Dm2 | Dm3 | CEW | | FAW | | ECB | | SBL | | VBC | |
| | | α1-2 | α3-5 | α6-7 | | | IC50 | LC50 | IC50 | LC50 | ILC50 | LC50 | ILC50 | LC50 | ILC50 | LC50 |
| 66 | IPRS-C18 | 1Ea | MP294 | 1Ea | MP372 | 1CaF3 | N.A. | N.A. | <1 | 11 | N.A. | N.A. | <3 | <3 | <3 | <3 |
| 67 | IPRS-C32 | 1Ea | MP294 | 1Ea | 1Cb | 1CaF3 | N.A. | N.A. | 27.02 | N.M. | N.D. | N.D. | N.D. | N.D. | N.D. | N.D. |
| 73 | IPRS-C58 | 1Ea | MP294 | 1Ea | MP372_2F1 | 1CaF3 | N.D. | N.D. | 40 | N.M | N.D. | N.D. | N.D. | N.D. | N.D. | N.D. |
| 74 | IPRS-C59 | 1Ea | MP294 | 1Ea | 1Ga_2F1 | 1CaF3 | N.D. | N.D. | 168 | N.M | N.D. | N.D. | N.D. | N.D. | N.D. | N.D. |
| 75 | IPRS-C71 | 1Ea | MP294 | 1Ea | GS028_2F1 | 1CaF3 | N.D. | N.D. | 25 | 325 | N.D. | N.D. | N.D. | N.D. | N.D. | N.D. |
| 76 | IPRS-C72 | 1Ea | MP294 | 1Ea | 1Eb_2F1 | 1CaF3 | N.D. | N.D. | 7 | 47 | N.D. | N.D. | N.D. | N.D. | N.D. | N.D. |
| 77 | IPRS-C73 | 1Ea | MP294 | 1Ea | 1Eb_2F2 | 1CaF3 | N.D. | N.D. | 3.2 | 46 | N.D. | N.D. | N.D. | N.D. | N.D. | N.D. |
| 68 | IPRS-C33 | 1Ea | MP294 | 1Ea | 1Ea | IfF3 | N.D. | N.D. | 102 | N.M | N.D. | N.D. | N.D. | N.D. | N.D. | N.D. |
| 69 | IPRS-C34 | 1Ea | MP294 | 1Ea | 1Ea | 9EbF3 | N.D. | N.D. | 196 | N.M | N.D. | N.D. | N.D. | N.D. | N.D. | N.D. |

TABLE 4-continued

Dm3 swapping activity spectrum on other Lepidopteran pests

| SEQ ID NO: | Variant name | Toxin Composition | | | | | Activity (ppm) | | | | | | | | | |
|---|---|---|---|---|---|---|---|---|---|---|---|---|---|---|---|---|
| | | Dm1 | | | Dm2 | Dm3 | CEW | | FAW | | ECB | | SBL | | VBC | |
| | | α1-2 | α3-5 | α6-7 | | | IC50 | LC50 | IC50 | LC50 | ILC50 | LC50 | ILC50 | LC50 | ILC50 | LC50 |
| 70 | IPRS-C35 | 1Ea | MP294 | 1Ea | MP372 | 1CbF2 | N.D. | N.D. | 92 | N.M | N.D. | N.D. | N.D. | N.D. | N.D. | N.D. |
| 71 | IPRS-C56 | 1Ea | MP294 | 1Ea | MP372 | 1AeF3 | N.D. | N.D. | 27 | N.M | N.D. | N.D. | N.D. | N.D. | N.D. | N.D. |
| 72 | IPRS-C57 | 1Ea | MP294 | 1Ea | 1Ea | 1BbF3 | N.D. | N.D. | >200 | N.M | N.D. | N.D. | N.D. | N.D. | N.D. | N.D. |
| 89 | IPRS-C66 | 1Jc | 1Ca | 1Jc | 1Jc | 1F2F3 | 20 | N.M | N.A. | N.A. | N.A. | N.A. | 10 | 29 | 865 | N.M |
| 78 | IPRS-C74 | 1Ea | MP294 | 1Ea | GS028_2F2 | 1CaF3 | N.D. | N.D. | <1 | 24 | N.D. | N.D. | N.D. | N.D. | N.D. | N.D. |

*N.A. means not active as tested; N.M. means no mortality as tested; N.D. means not determined; and F number is the crossover point

TABLE 5

Cry toxin Dm3 fragments crossover points:

| SEQ ID NO: | amino acid consensus sequence at which Dm3 fragment fused to C16 and C18 backbones | Dm2-Dm3 Cross over point |
|---|---|---|
| 251 | WTHHS | F2 |
| 252 | ITQIP | F3 |
| 253 | GFTGG | F4 |
| 254 | RYASS | F5 |
| 255 | KTMEI | F6 |
| 256 | TFRYT | F7 |
| 257 | PFSFR | F8 |

Example 6: Sequential Alpha Loop 3-5 and Dm3 Shuffling on MP1068 Backbone

MP1068 (SEQ ID NO: 214) is a proprietary Cry toxin. It has 63% homology to Cry1Ac. Its Dm1 is 84% similar to Cry1Ac, Dm2 is unique with 45% homology to Cry1Nb and Dm3 has 79% homology to Cry1Bh. Since MP1068 Dm2 is very unique, variants based on MP1068 Dm2 as backbone were created. Initially, MP1068 toxin region was expressed as MBP fusion protein, but attempts were unsuccessful as all expressed protein was in insoluble fraction. To overcome the soluble expression problem, shuffling was performed on the alpha loop 3-5 fragment, which is exposed to solvents (see FIGS. 5 and 6), to generate variants of MP1068 with insect activity followed by Dm3 shuffling on that backbone to improve activity.

MP1068 in pMal vector backbone was obtained by inverse PCR backbone specific primers. This vector backbone has all vector components along MP1068 toxin except the alpha loop 3-5 region. 23 alpha loop 3-5 fragments were PCR amplified form synthesized Dm1 fragments (Table 5). Equal amounts of all alpha loop 3-5 fragments were pooled and gel purified. Alpha loop 3-5 PCR fragment pool and MP1068 vector backbone were assembled using Geneart (Invitrogen) homology based assembly kit. Assembled reaction was transformed into BL21 cells and plated. Three 96-well plates of colonies were collected and directly tested for their soluble expression. All expressed clones were re-arrayed and sent for sequencing to remove redundant sequences.

Sequencing data revealed that there were 9 unique MP1068 variants with different alpha loop 3-5 sequences swapped. All 9 variants were tested in a diet assay for their insect activity against CEW, FAW and ECB (Table 6 and FIG. 7).

TABLE 6

MP1068 alpha swapped variant insect activity

| SEQ ID NO: | Variant Name | Toxin Composition | | | | | Activity (ppm) | |
|---|---|---|---|---|---|---|---|---|
| | | Dm1 | | | Dm2 | Dm3 | CEW | |
| | | α1-2 | α3-5 | α6-7 | | | IC50 | LC50 |
| 100 | IPRS-C23 | MP1068 | 1Aa | MP1068 | MP1068 | MP1068 | 5.5 | 62 |

Activity (ppm)

| SEQ ID NO: | Variant Name | FAW | | ECB | | SBL | | VBC | |
|---|---|---|---|---|---|---|---|---|---|
| | | IC50 | LC50 | ILC50 | LC50 | ILC50 | LC50 | ILC50 | LC50 |
| 100 | IPRS-C23 | 7.28 | N.M | 4.3 | 117 | N.D. | N.D. | N.D. | N.D. |

*N.A. means not active as tested; N.M. means no mortality as tested; and N.D. means not determined IPRS-C23 was selected as backbone for further Dm3 shuffling (See Example 5) as it was more active compared to two other active clones as tested. Six Dm3s, from Cry1Ca, Cry1Cb, Cry1Da, MP258 (See US 20160194364 A1, SEQ ID NO: 16, herein incorporated by reference), Cry1Bb, and Cry1Ja were selected as a source of diversity. Five fragments of (crossover points 1-4, also named F2 to F5 crossover points) of each Dm3 were obtained by PCR amplification. The individual fragments (for example, F2s of all Dm3s in the diversity) were pooled into 5 Dm3 pools (F2 to F5 pools). The vector backbone was obtained by inverse PCR excluding the region to be swapped. In order to facilitate homology based assembly, the ends of the vector backbone and the inserts (Dm3 pools) had a 15 bp identical sequence overlap. The insert pools and vector backbones were gel purified assembled using NEB builder or Gene Art assembly kits. The assembly reaction was then transformed into BL21 cells, and collected colonies were screened by sequencing. Individual unique clones were re-arrayed and checked for expression using Bio-Rad 96-well E-Page gel and blotting. Clones expressing hybrid toxins in soluble fraction were grown in 150 ml culture of magic media and purified by standard Ni-NTA purification and tested for their insect activity.

All possible 30 clones were purified and tested for their activity against CEW, FAW and ECB and 10 were found to be active variants as tested 6 of those 10 active variants showed improved activity against all three insects tested (Table 7).

Native GS062 was family shuffled Dm1 on GS062 backbone to improve ECB activity and then shuffled Dm3 to add CEW or FAW specificity.

Whole Dm1s from several proprietary Cry1 toxins were PCR amplified from their respective parent Cry toxins. All PCR amplified fragments were pooled and gel purified to remove any remnants of parent clones. Then, pooled Dm1 fragments were allowed to recombine using a PCR with natural amino acid diversity representing various Dm1 fragments. Four 50 µL assembly reactions containing 0.5-1.0 µM pooled library oligos and Dm1 fragments were assembled in a Herculase II (Stratagene) reaction. A subsequent PCR reaction to amplify the fully extended approximately 1 Kb gene was carried out by adding 0.5 µM of flanking primers with 30 bp homology to the pMal vector backbone containing GS062 Dm2, Dm3.

Vector backbone was obtained by inverse PCR of GS062 toxin in pMal vector. Inverse PCR primers were designed in such a way to exclude GS062 Dm1 from the PCR fragment, so, inverse PCR vector backbone fragment would include all pMal vector components along with MBP, GS062 Dm2 and Dm3.

TABLE 7

C23 Dm3 shuffling activity

| SEQ ID NO: | Variant Name | Toxin Composition | | | | | Activity (ppm) | |
|---|---|---|---|---|---|---|---|---|
| | | Dm1 | | | | | CEW | |
| | | α1-2 | α3-5 | α6-7 | Dm2 | Dm3 | IC50 | LC50 |
| 102 | IPRS-C24 | MP1068 | 1Aa | MP1068 | MP1068 | 1Cb (F2) | 2 | 14 |
| 103 | IPRS-C25 | MP1068 | 1Aa | MP1068 | MP1068 | 1Cb (F3) | <1 | 15 |
| 104 | IPRS-C26 | MP1068 | 1Aa | MP1068 | MP1068 | 1Da (F3) | 17 | 260 |
| 105 | IPRS-C27 | MP1068 | 1Aa | MP1068 | MP1068 | 1Ja (F2) | 11 | N.M |
| 106 | IPRS-C28 | MP1068 | 1Aa | MP1068 | MP1068 | 1Ja (F3) | 9 | 580 |
| 107 | IPRS-C29 | MP1068 | 1Aa | MP1068 | MP1068 | MP258 (F4) | 2.19 | 27 |
| 108 | IPRS-C41 | MP1068 | 1Aa | MP1068 | MP1068 | MP258 (F2) | 5 | 100 |
| 109 | IPRS-C42 | MP1068 | 1Aa | MP1068 | MP1068 | MP258 (F3) | <1 | 25 |
| 110 | IPRS-C43 | MP1068 | 1Aa | MP1068 | MP1068 | MP258 (F5) | <1 | 31 |
| 111 | IPRS-C44 | MP1068 | 1Aa | MP1068 | MP1068 | 1Bb (F3) | 11.4 | 224 |

| SEQ ID NO: | Variant Name | Activity (ppm) | | | | | | |
|---|---|---|---|---|---|---|---|---|
| | | FAW | | ECB | | SBL | | VBC | |
| | | IC50 | LC50 | ILC50 | LC50 | ILC50 | LC50 | ILC50 | LC50 |
| 102 | IPRS-C24 | 7 | N.M | 1.12 | 930 | <3 | <3 | 2.3 | 3.5 |
| 103 | IPRS-C25 | 3 | N.M | 11 | 567 | <5 | <5 | 1 | 1 |
| 104 | IPRS-C26 | 148 | N.M | N.D | N.D. | N.D | N.D. | N.D | N.D. |
| 105 | IPRS-C27 | 5 | N.M | N.D | N.D. | N.D | N.D. | N.D | N.D. |
| 106 | IPRS-C28 | <1 | N.M | N.D | N.D. | N.D | N.D. | N.D | N.D. |
| 107 | IPRS-C29 | 5.5 | N.M | N.D | N.D. | N.D | N.D. | N.D | N.D. |
| 108 | IPRS-C41 | 16 | N.M | 1 | 269 | <3 | <3 | 47 | 124 |
| 109 | IPRS-C42 | 3.6 | N.M | 1.2 | 105 | <2 | <2 | 120 | 1020 |
| 110 | IPRS-C43 | 4.5 | N.M | 1 | 427 | <3 | <3 | 61 | 266 |
| 111 | IPRS-C44 | N.A. | N.A. | N.D. | N.D. | N.D. | N.D. | N.D. | N.D. |

*N.A. means not active as tested; N.M. means no mortality as tested; N.D. means not determined; and F number is the crossover point Example 7: Sequential Dm1 and Dm3 Shuffling on GS062 Backbone (C45, 46, 47, 48 and C49)

GS062 (SEQ ID NO: 224) is a proprietary toxin with 62% homology to Cry1Da. Domain analysis revealed that it is a hybrid toxin with domain-1 is Cry1Ac type (77%), Dm2 is Cry1Ca type (80%) and Dm3 is Cry1Hb type (79%). GS062 was active only on ECB but not on CEW and FAW as tested.

Rescued Dm1 mixtures were assembled using Invitrogen Geneart DNA fragment assembly kit. The assembly reaction was transformed into Invitrogen Top10 chemically competent cells. After sequence analysis, all colonies were pooled and made a mixed plasmid preparation. The mixed plasmid was transformed into Lucigen Electro competent BL21 cells for protein expression.

Approximately 3000 E. coli (BL21) colonies were collected and screened for full-length MBP-toxin protein expression using Western blotting. Approximately 400 clones expressing hybrid toxin in soluble fraction in *E. Coli* were collected and re-arrayed. Protein was purified from these clones and submitted for their ECB activity in a Yes/No assay. Then, 40 active clones, based on ECB activity, among the 400 clones screened were re-arrayed and sequenced. Upon sequencing, redundant clones (clones with same sequence) were removed and only 16 unique clones were re-arrayed, purified and tested for their specific activity on ECB and SBL in a dose response manner.

Due to lack of sufficient homology among Dm1s selected for shuffling, many clones have either whole Dm1 or Dm1 with random mutations swapped on to GS062 backbone (Dm2-Dm3). Dm1s of these 16 hits comes from MP477 (SEQ ID NO: 223), GS128 (SEQ ID NO: 244), and GS002 (SEQ ID NO: 235). These 16 clones were tested for their ECB and SBL activity in dose response manner. None of these 16 clones yielded any measurable specific activity number (IC or LC50) on ECB as tested, but 1 clone with GS002 Dm1 showed good SBL activity (Table 8).

ID NOs: 275-278, encoded by SEQ ID NOs: 271-274 respectively).

Example 8: Dm1 Alpha Loop Swaps (Alpha Loop 3, 4, 5, 3-4, 4-5, and 3-5 Shuffling) on C16 and C21

Based on the success of alpha loop 3-5 fragment shuffling strategy (employed in different block shuffling strategies), shuffled individual and combination of alpha helices were tested to show which alpha helix or helices may improve activity or soluble expression. Alpha loop 3-5 fragment shuffled in previous libraries included alpha loop 3, 4, and only a portion of alpha loop 5. In this library, shuffled alpha loop 3, Alpha loop 4, and whole Alpha loop 5 individually and in combination on two block shuffled variants C16 and C21. Alpha loop 3-5 fragment shuffled in this library was slightly longer than alpha loop 3-5 fragments shuffled in all previous libraries (See FIGS. 8 and 9).

TABLE 8

GS062 backbone swapped Dm1 Activity

| SEQ ID NO: | Variant Name | Toxin Composition | | | Activity (ppm) | | | | | | | | | |
|---|---|---|---|---|---|---|---|---|---|---|---|---|---|---|
| | | | | | CEW | | FAW | | ECB | | SBL | | VBC | |
| | | Dm1 | Dm2 | Dm3 | IC50 | LC50 | IC50 | LC50 | ILC50 | LC50 | ILC50 | LC50 | ILC50 | LC50 |
| 112 | IPRS-C49 | GS002 | GS062 | GS062 | N.A | N.A | N.A | N.A | 1300 | 1842 | 12 | 18 | 80 | N.M |

*N.A. means not active as tested; N.M. means no mortality as tested; and N.D. means not determined IPRS-C49 showed no activity on CEW and FAW as tested, but was highly active on SBL, moderately active on VBC, and slightly active on ECB (See Table 8).

IPRS-C49 (SEQ ID NO: 112) was selected as backbone for further Dm3 shuffling (See Example 3) as it was more active compared to three other active clones. Six Dm3s, from Cry1Ca, Cry1Cb, Cry1Da, Cry1Ab, Cry1Ac, and Cry1Be were selected as a sources of diversity.

All possible 30 clones were purified and tested for their activity against CEW and FAW. Four variants were active on CEW but not on FAW as tested. Two of the four active variants were selected for further Lepidopteran activity spectrum studies, and showed improved activity against ECB, SBL and VBC (Table 9).

Alpha loops 3, 4, 5, 3-4, 4-5, and 3-5 were PCR amplified from 45 synthesized Dm1 fragments (See FIG. 11). Different alpha loop fragments of Cry1Ca were obtained from C21 which contained Cry1Ca alpha loop 3-5 fragment. Six different Individual and combinatorial alpha loop fragment pools per backbone (alpha loop 3 pool, 4 pool, 5 pool, 3-4 pool, 4-5 pool, and 3-5 pool) were made. Alpha fragments of Cry1Ea and Cry1Ca were not included in pools corresponding to C16 and C21 respectively to avoid generating parent backbones. All pools were digested with Dpn-1 and gel purified to avoid parent contamination. Table 10 shows which different domain 1 alpha helices were PCR amplified. Different alpha fragments of Cry1Ca were obtained as C21 contains Cry1Ca alpha loop 3-5 fragment.

TABLE 9

C49 Dm3 shuffled variant activity.

| SEQ ID NO: | Variant Name | Toxin Composition | | | Activity (ppm) | | | | | | | | | |
|---|---|---|---|---|---|---|---|---|---|---|---|---|---|---|
| | | | | | CEW | | FAW | | ECB | | SBL | | VBC | |
| | | Dm1 | Dm2 | Dm3 | IC50 | LC50 | IC50 | LC50 | ILC50 | LC50 | ILC50 | LC50 | ILC50 | LC50 |
| 97 | IPRS-C45 | GS002 | GS062 | 1Cb (F2) | 28 | 120 | N.A. | N.A. | 65 | 320 | <3 | <3 | <3 | <3 |
| 99 | IPRS-C47 | GS002 | GS062 | 1Be (F3) | 20 | 70 | N.A. | N.A. | 24 | 119 | <3 | <3 | <3 | <3 |
| 96 | IPRS-C46 | GS002 | GS062 | 1Cb (F1) | 12 | 43 | N.D | N.D. | N.D | N.D. | N.D | N.D. | N.D. | N.D. |
| 98 | IPRS-C48 | GS002 | GS062 | 1Da (F2) | 40 | N.M | N.D | N.D. | N.D | N.D. | N.D | N.D. | N.D. | N.D. |

*N.A. means not active as tested; N.M. means no mortality as tested; N.D. means not determined; and F number is the crossover point Similar shuffling was completed using G5047 (SEQ ID NO: 228). All possible 30 clones were purified and tested for their activity against CEW and FAW. Four variants were active on FAW. All four showed FAW activity as tested (SEQ C16 and C21 vector backbones for corresponding alpha loop 3, 4, 5, 3-4, 4-5, and 3-5 regions were generated by inverse PCR, excluding the region to be shuffled using backbone specific primers.

Twelve assembly reactions (six pools/backbone) were performed. Gel purified vector backbones were assembled with respective alpha helix fragment pool to obtain all variants in pMal vector to be expressed as MBP-fusion proteins. All unique variants were re-arrayed after sequence confirmation, and only those clones that were expressed in the soluble fraction were further purified and tested for their insect activity. C16 based variants were tested against FAW, and C21 variants were tested against CEW as C16 and C21 are active on FAW and CEW respectively. Fourteen active variants were isolated (8 from C16 backbone and 6 from C21 backbone). Table 10 shows the tested activity of the variants.

TABLE 10

Insecticidal activity of C16 and C21 alpha loop 3, 4, 5, 3-4, 4-5, and 3-5 variants

| SEQ ID NO: | Variant name | Toxin Composition | | | | | | | Activity (ppm) | | | |
|---|---|---|---|---|---|---|---|---|---|---|---|---|
| | | Dm1 | | | | | Dm2 | Dm3 | FAW | | CEW | |
| | | α1-2 | α3 | α4 | α5 | α6-7 | | | IC50 | LC50 | IC50 | LC50 |
| 79 | IPRS-C36 | 1Ea | Da | | MP294 | 1Ea | 1Ea | 1CaF3 | 15 | 51 | N.D | |
| 80 | IPRS-C37 | 1Ea | | MP294 | Aa | 1Ea | 1Ea | 1CaF3 | 3.2 | N.M | N.D | |
| 81 | IPRS-C38 | 1Ea | MP294 | Ad | MP294 | 1Ea | 1Ea | 1CaF3 | 5.1 | N.M | N.D | |
| 82 | IPRS-C39 | 1Ea | | MP294 | Ae | 1Ea | 1Ea | 1CaF3 | 2.4 | N.M | N.D | |
| 83 | IPRS-C52 | 1Ea | | MP294 | Db | 1Ea | 1Ea | 1CaF3 | 17 | N.M | N.D | |
| 84 | IPRS-C53 | 1Ea | | MP294 | Dc | 1Ea | 1Ea | 1CaF3 | 6.2 | N.M | N.D | |
| 85 | IPRS-C54 | 1Ea | | MP294 | Eb | 1Ea | 1Ea | 1CaF3 | 4.1 | N.M | N.D | |
| 86 | IPRS-C55 | 1Ea | | MP294 | Hb | 1Ea | 1Ea | 1CaF3 | 42.5 | N.M | N.D | |
| 112 | IPRS-C49 | 1Jc | 1Aa | 1Ca | 1Ca | 1Jc | 1Jc | 1Jc | N.D | | 9.20 | N.M |
| 91 | IPRS-C61 | 1Jc | 1Jc | 1Ca | 1Ca | 1Jc | 1Jc | 1Jc | N.D | | 6.37 | N.M |
| 92 | IPRS-C62 | 1Jc | | 1Ca | 1Ah | lJc | 1Jc | 1Jc | N.D | | 3.95 | N.M |
| 93 | IPRS-C63 | 1Jc | | 1Ca | 1Ea | lJc | 1Jc | 1Jc | N.D | | 3.07 | N.M |
| 94 | IPRS-C64 | 1Jc | | 1Ca | 1Jc | lJc | 1Jc | 1Jc | N.D | | 4.18 | N.M |
| 95 | IPRS-C65 | 1Jc | | 1Ca | 1Jd | lJc | 1Jc | 1Jc | N.D | | 2.39 | N.M |

SEQUENCE LISTING (278 sequences)

SEQ ID NO: 1 - DNA, 1944 bp, Artificial Sequence
  Synthetic
atgcctagcaaccgtaagaacgagaacgaaatcatcaacgcagtaagcaatcacagcgcgcaaatggacctgagcctggacgcgcgcattgaggatagcttgtgcgttgcagaggtgaacaacattgacccgttcgttagcgcgtcgacggtccaaaccggcattagcatcgccggtcgcatcctcggtgtgttgggtgtcccgttcgcgggtcagctggcgagcttctacagcttcctggtgggcgagttatggcctagcggtcgcgacccgtgggagatctttatggagcacgtggagcaaatcgttcgtcaacagatcacggacagcgtgcgcgacaccgcaattgctcgtctggaaggcctgggtcgtggctaccgtagctatcagcaagctctggaaacctggctggataatcgtaatgacgcgcgttcccgcagcattattcgtgaacgttacatcgcgctggagctggacattacgaccgctattccgctgttctccattcgtaatcaagaagtgccgctgctgatggtctatgcgcaagccgccaatttgcatctgcttctgctgcgtgacgcaagcctgtttggttctgagtggggcatgagctctagcgatgtcaatcagtactatcaagagcagattcgttacaccgaagaatacagcaatcactgtgttcagtggtacaataccggtttgaacaatctgagaggcaccaacgcggaaagctggctgcgctataatcagtttcgtcgtgatctgaccctgggcgtcttggatctggttgcactgttcccgtcttacgatacgcgcgtgtacccgatgaatacctctgcccagctgacgcgcgaaatttacaccaatccagtattcgaaaactccccggttaatatcaacttggtgaacggtttcaatcgggttgaatatggtgtgcgtcagccgcacctgatggatcaccttatgaacgtgtcaatttctgaagaagattatcgtggggatacgttctggggcggccactccattgcaagcgtggataccggaggtaacctggtggggtttccgttctacggcaacttcgatcgttttcgttttcagaccattaatgcgcaacaattcccgcttttccggacgcttagcgacccggtttataatctgtccaccagcgggggtcgtaatcgccttttcgccctggaagggattggcttccagcaagccgtaactggtaccacgcgggcatttcgccgtgttggcaccattgattcactgattgagatcccgccacaagatgaaagtgaagtaccttggaatggttattcccatgtactgaatcacatcacctttattaattggccggccgttttcctgcaaggcgaacgtattgcgtcgccgatgtttagctggacccatcgctccgctaccttaacgaatactattgatccggagcgcatcaaccagattccgttggtcaaaggtttccgcgtctggggtggtacgagcgtgattacgggtccgggatttaccggcggtgatatcctgcgtcgtaacacctttggtgactttgttagcctgcaagtgaatatcaatagcccgattactcagcgctaccgtctgcgtttccgctatgccagctcccgtgacgcacgcgtgatcgttctgacgggtgcggcaagcaccggtgtgggtggccaggtttctgttaacatgccgctgcagaaaaccatggaaatcggtgaaaatctgacgtcgcgtacctttcgctataccgatttctccaacccattctcatttcgtgcgaatccggatatcatcggcattagcgagcaacctctgtttggtgcgggcagcattagcagcggtgagctgtacattgacaaaattgagattatcctggcagatgcgacgttcgaagccgagtccgatctggaacgcgcgcagaagtaa

SEQ ID NO: 2 - DNA, 1986 bp, Artificial Sequence
  Synthetic
atgcctagcaaccgtaagaacgagaacgaaatcatcaacgcagtaagcaatcacagcgcgcaaatggacctgagcctggacgcgcgcattgaggatagcttgtgcgttgcagaggtgaacaacattgacccgttcgttagcgcgtcgacggtccaaaccggcattagcatcgccggtcgcatcctcggtgtgttgggtgtcccgttcgcgggtcagctggcgagcttctacagcttcctggtgggcgagttatggcctagcggtcgcgacccgtgggagatctttatggagcacgtggagcaaatcgttcgtcaacagatcacggacagcgtgcgcgacaccgcaattgctcgtctggaaggcctgggtcgtggctaccgtagctatcagcaagctctggaaacctggctggataatcgtaatgacgcgcgttcccgcagcattattcgtgaacgttacatcgcgctggagctggacattacgaccgctattccgctgttctccattcgtaatcaagaagtgccgctgctgatggtctatgcgcaagccgccaatttgcatctgcttctgctgcgtgacgcaagcctgtttggttctgagtggggcatgagctctagcgatgtcaatcagtactatcaagagcagattcgttacaccgaagaatacagcaatcactgtgttcagtggtacaataccggtttgaacaatctgagaggcaccaacgcggaaagctggctgcgctataatcagtttcgtcgtgatctgaccctgggcgtcttggatctggttgcactgttcccgtcttacgatacgcgcgtgtacccgatgaatacctctgcccagctgacgcgcgaaatctacaccgacccgatcggtcgcactaacgctccatccggtttcgcgagcaccaactggttcaacaataacgcaccgagcttcagcgcgatcgaggccgcgatctttcgtccgccgcacctgatggattttccagagcagttaactatttatagcaccctgtcccgttggtctaacacgcagtatatgaacatttgggtgggccaccgcctggagagccgcactatcggaggttcactgaatacctccacgcaaggttctacaaataccagtattaaccccgtacgtttgcagttcacggcgcgtgatgtttaccgtaccgaaagcctggctggccttaacattttccttactcagccggttaatggtgtaccatgggtgcgcttcaactggcgcaatccgctgaattcgctgcgtgggtccttgctgtatactattggctataccggcgtgggcactcaactgcaggattcagaaaccgagctgccgccagaaacaacggaacgtccgaactacgaatcatattcccatcgcctgagccacatcgggctgattagcagcagccatgtccgcgcattggtgtacagctggacccatcgctccgctaccttaacgaatactattgatccggagcgcatcaaccagattccgttggtcaaaggtttccgcgtctggggtggtacgagcgtgattacgggtccgggatttaccggcggtgatatcctgcgtcgtaacacctttggtgactttgttagcctgcaagtgaatatcaatagcccgattactcagcgctaccgtctgcgtttccgctatgccagctcccgtgacgcacgcgtgatcgttctgacgggtgcggcaagcaccggtgtgggtggccaggtttctgttaacatgccgctgcagaaaaccatggaaatcggtgaaaatctgacgtcgcgtacctttcgctataccgatttctccaacccattctcatttcgtgcgaatccggatatcatcggcattagcgagcaacctctgtttggtgcgggcagcattagcagcggtgagctgtacattgacaaaattgagattatcctggcagatgcgacgttcgaagccgagtccgatctggaacgcgcgcagaagtaa

SEQ ID NO: 3 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 4 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattaaccaacgtatcgaagaattcgcgcgtaaccaggcaatttcacgcctggaaggtctgagtaacctttaccagatttatgctgaatcgttccgggaatgggaagcagaccctaccaacccggcacttcgtgaggaaatgcgcatccagttcaatgatatgaatagcgcgctgacaactgctatcccacttttcgccgttcagaattatcaagtgccgctgctgtctgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 5 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgatcggccagcgtatcgaagaattcgcacgcaatcaggccatttctcgtctgcaaggcctgtctaacctgtatcgcatctacaccaatgctttcaaaaattgggaagtagacccgactaatccggctctgcgcgaagaaatgcgcattcagtttaacgatatgaactccgcgctgacgactgcaattccgctgttctctgttcagggttacgaaatcccgctgctgtctgtctacgttcaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 6 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 7 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattaaccaacgtatcgaagaattcgcgcgtaaccaggcaatttcacgcctggaaggtctgagtaacctttaccagatttatgctgaagcgttccgggaatgggaagcagaccctaccaacccggcacttactgaggaaatgcgcatccagttcaatgatatgaatagcgcgctgacaactgctatcccacttttcaccgttcagaattatcaagtgccgctgctgtctgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 8 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccaaatcccgctggtgaagggctttcgtctgggtggcggcacttccgtaatcaaaggtccgggtttcacgggtggtgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 9 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgatcggccagcgtatcgaagaattcgcacgcaatcaggccatttctcgtctgcaaggcctgtctaacctgtatcgcatctacaccaatgctttcaaaaattgggaagtagacccgactaatccggctctgcgcgaagaaatgcgcattcagtttaacgatatgaactccgcgctgacgactgcaattccgctgttctctgttcagggttacgaaatcccgctgctgtctgtctacgttcaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccaaatcccgctggtgaagggctttcgtctgggtggcggcacttccgtaatcaaaggtccgggtttcacgggtggtgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 10 - DNA, 1893 bp, Artificial Sequence
  Synthetic
atggaaatcgtgaataaccagaaccagtgcgtgccgtacaattgtctgaataaccccgaaaacgagattctggacatcgagcgcagtaacagcacagttgctaccaacatcgcactggaaatttcgcgtttactggcctccgccacgccaatcggggggattctgctgggtctgtttgatgctatctggggaagtattggcccgagccaatgggatctgtttttggagcaaattgaacagctgattggccagcgcattgaagaattcgcacgcaatcaagccatctcccgcctggaagggttgagtaacctttatcgtatctacacgaatgcctttaagaattgggaagccgatccgaccaatccagtgttgcgggaggaaatgcgcattcagtttaatgatatgaatagtgcgttcacgaccgcaatcccattattttcagtacaaggttacgaaattcctcttcttggcgtctatgtgcaggctgcgaacctgcatttgtcagtcttacgtgacgttagtgtgtttggccaggcttggggttttgacattgcgacaattaactcccgctataacgatctgacgcgtctgatccctatttatactgattatgctgtccgttggtacaatacgggtctggatcgtttaccgcgcaccggcgggttgcgtaattgggcacgtttcaaccaattccgccgggaactgactatttcggttctggacatcattagttttttccgtaattacgatagtcggctgtatccgatccccacgtcgtctcagctgacccgggaagtgtatacggaccctgttattaacattaccgattatcgcgttgggccgagctttgaaaatattgaaaattctgccattcgttcgccgcacctgatggacttcctgactaatattatcatcgataccgatctgattcgtggcgtgtattactgggcggggcaccgcattaacagtcgctttacgggaacagcatttccgcacattatcacgagtccacagtacggtattacagctaacgccgagccccgccgcaccattgcaccaggcccatttcaaggtgtgccttccctgttataccgtacgctgagtgatccgtttttccggcgctcagataatatcagtccgacccttggtatcaatgtggttcaaggagtcggatttctgcagccaaacaattttgaatccctttaccgtcgtcgtgggactgtcgatagtctgaacgagttacccattgatggagaaaactcgttagtaggttactcccaccgcctgagtcatgtgacgttgacccgctctttatacaacacgaacattacgtctctgccgactttcgtctggacccatcattcagcgaccaatacgaataccatcaaccccgatattatcacccagatcccactggtcaaaggttttcgtgtatggggaggaacatcggttattactggaccgggatttaccggcggtgatattcttcgccgcaacacctttggagactttgttagcctgcaagtgaacatcaatagtccaattacgcaacgctatcgtctgcgctttcgttatgctagctctcgtgacgcgcgtgtgatcgtactgacgggcgcagccagcacaggcgtgggcggtcaagtctctgtgaacatgcctctgcagaaaacgatggagattggggaaaatctgaccagccgcacttttcgttacacggatttttctaatccgttctccttccgggccaatccagacattatcgggatttcagaacagccattattcggcgcggggtcaatttcatctggagaactgtatattgataaaatcgaaattattctggcggatgccacgttcgaggccgaaagtgatttggaacgtgcccagaaataa

SEQ ID NO: 11 - DNA, 1875 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggatgttcttaataacttaactatttttacggattggttttccgtcggccgcaacttttattggggcggccaccgcgtcattagcaatcgcatcggaggtggaaacattacgagcccaatttatggtcgcgaagcaaaccaagagccgccacgctcgtttaccttcaatggtccggtgttccggacgcttagcaatccgactttccggccactgcagcagccgtggccggcgcctccgttcaatctgcgcggggtagagggggtcgaattttcaactccactgaattcttttacctatcgtggccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 12 - DNA, 1848 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgttagtgaaagccttcaacttgtcctccggtgcggctgtggttcgtggtccaggcttcacagggggtgacattctgcgtcgtaaaaacacagggacctttggcgacattcgtgtcaacattaaccctccgttcgcccagcgctatcgtgtgcgtattcgttatgccagcacaaccgacctgcaattccatacctctattaacggaaaggctatcaatcagggtaactttagtgccactatgaatcgtggcgaggacttagattataaaacctttcgtaccgtaggttttactacccctttttcattttccgacgttcaaagcacctttacgatcggtgcctggaactttagctcaggtaatgaagtttatatcgatcgcatcgaatttgtaccggtggaggtcacctacgaggcggaatatgactttgaaaaagcccaggaataa

SEQ ID NO: 13 - DNA, 1848 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccggttgtaaaggcgtacgaactgagcagcggcgcgaccgtagttaaaggtccgggttttactggcggcgacgttattcgtcgcaccaacactggtggcttcggcgctatccgtgtatctgtcactggcccgctgacccagcgttatcgcattcgttttcgttatgcgtccaccatcgatttcgattttttcgtgacgcgcggtggtaccaccattaacaattttcgttttacccgtactatgaaccgcggtcaggaatcccgctacgaaagctaccgcaccgtagaattcactaccccgttcaacttcacgcagtcccaggatatcatccgtaccagcattcagggtctgtccggcaatggtgaggtatatctggaccgtatcgaaatcatccctgtgaaccctacccgtgaggccgaggaggatctggaagcggcgaaaaaataa

SEQ ID NO: 14 - DNA, 1854 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggatttcttaactaatataattattgacactgatttaataagaggtgtttactattgggcaggacatcgtataaattctcgctttaccgggaccgcttttccacatataataacatctcctcaatatggaataactgcaaacgcagaaccaagacgtacaatagcgcctggtccttttcaaggtgtgccttccctactttatagaacactatcagaccctttcttccgaagatcagacaatattagtccaaccttagggataaatgtagtacagggggtagggttcttacaaccaaataattttgaatctctatatagaaggcgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccgatcgcaacatcatttacccggacgttatcaaccaaatcccgctggtgaaggcgtttaacctgacctctggcacttccgtagtgcgtggtccgggtttcacgggtggcgatattattcgtactaacgtgaacggcagcgtcctgtccatgtccctgaacttcagcaacactactctgcagcgctaccgcgttcgcgttcgttacgccgcatctcagactatggtgatgtccgtcaccgttggcggttccaccaccggcaaccagggtttcccatctaccatgtctgccaatggcgcgctgacctcccagagcttccgtttcgcagaatttccggtaggcatctctgcttctggttctcagggtgcgtccatttctatcagcaacaacgtaggccgtcagatgttccatctggaccgcatcgaatttctgccggtgacctccaccttcgaagaagaatacgatctggaacgtgcgcaagaataa

SEQ ID NO: 15 - DNA, 1857 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggatttcttaactaatataattattgacactgatttaataagaggtgtttactattgggcaggacatcgtataaattctcgctttaccgggaccgcttttccacatataataacatctcctcaatatggaataactgcaaacgcagaaccaagacgtacaatagcgcctggtccttttcaaggtgtgccttccctactttatagaacactatcagaccctttcttccgaagatcagacaatattagtccaaccttagggataaatgtagtacagggggtagggttcttacaaccaaataattttgaatctctatatagaaggcgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcggagtttaataacattattccgtcttctcaaatcacccagatcccgctgactaaatccaccaacctgggttccggcacctctgtagtaaaaggtcctggtttcaccggtggtgatattctgcgccgtacgagcccgggtcagatctccacgctgcgtgttaacattactgccccgctgtctcagcgttatcgcgttcgcatccgctacgcttctactacgaacctgcagttccatacttccatcgacggtcgtccgattaaccaaggtaacttcagcgcgactatgtcttccggcggcaacctgcaatctggttctttccgcactgtgggtttcacgaccccgtttaacttcagcaacggctcctctgttttcactctgagcgcccatgtttttaatagcggcaacgaggtgtacatcgaccgtattgaattcgttcctgctgaagttactttcgaagctgaatacgacctggaacgtgcacaggaataa

SEQ ID NO: 16 - DNA, 1845 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggttaaggctctgaacctgcactctggcgttaccgttgttggtggtccgggtttcaccggtggtgatatcctgcgccgtacgaacaccggcactttcggcgacatccgcctgaatatcaatgtaccactgagccaacgctaccgtgtacgcattcgctacgcttccactaccgacctgcagttcttcactcgtatcaatggtaccaccgttaacatcggcaacttctctcgcaccatgaaccgtggtgataacctggaataccgctctttccgtaccgcaggtttttctacgccgtttaacttcctgaacgcccagtctactttcacgctgggcgcgcagtctttcagcaaccaggaagtctacattgaccgtgtggaattcgtgccggcggaagttacctttgaagcagaatatgacctggaacgtgcgcaaaaataa

SEQ ID NO: 17 - DNA, 1893 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggatttcttaactaatataattattgacactgatttaataagaggtgtttactattgggcaggacatcgtataaattctcgctttaccgggaccgcttttccacatataataacatctcctcaatatggaataactgcaaacgcagaaccaagacgtacaatagcgcctggtccttttcaaggtgtgccttccctactttatcgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 18 - DNA, 1893 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttattgaccgtatcgtgatctacactaattctgtgcgttccacgccgtactgggcgggccacgaagtgatctcccgtcgtactggtcaaggtcagggtaacgaaattcgtttcccgctgtatggcgtagcggcaaacgcggaaccaccggtaaccatccgcccaaccggtttcaccgatgaacagcgtcagtggtatcgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 19 - DNA, 1893 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggatttcttaactaatataattattgacactgatttaataagaggtgtttactattgggcaggacatcgtataaattctcgctttaccgggaccgcttttccacatataataacatctcctcaatatggaataactgcaaacgcagaaccaagacgtacaatagtgcctggtccttttcaaggtgtgccttccctactttatcgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 20 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacatcatcattgacaccgatctgatccgtggcgtgcactactgggctggtcaccgtgttacgtcccacttcactggctccagccaggtgatctcttccccacagtacggcattactgcgaacgcggaaccatctcgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 21 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgataacatcatgccaaccctgggtatcaacgtagttcagggtgtcggcttcattcagccgaacaacggtgaagtactgtaccgtcgccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 22 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaaccctttcttccgaagatcagacaatattagtccaaccttagggataaatgtagtacagggggtagggttcttacaaccaaataattttgaatctctatatagaaggcgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 23 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgatttctcagcgtatcgaggaattcgcgcgtaaccaggcaatttcccgtctggaaggtctgtccaacctgtataaagtgtatgttcgtgcgttcagcgactgggaaaaagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 24 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatcaggtaccgctgctgtctgtgtacgtgcaggcggctaacctgcacctgtccgtcctgcgtgacgtttctgtattcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 25 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggcactgacggaagaaatgcgtatccagttcaacgacatgaactctgctctgacgacggccatccctctgttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 26 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatcaggtaccgctgctgtctgtgtacgtgcaggcggtaaacctgcacctgtccgtcctgcgtgacgtttctgtattcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 27 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaagtggcactgctgtctgtttacgtgcaggccgcgaacctgcatctgtccgttctgcgcgatgtttctgtttatggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 28 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgagattccactgctgtccgtgtatgttcaggcagcgaacctgcatctgtccatcctgcgtgacgtaagcgtattcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 29 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaatcccgctgctgtctgtctacgttcaggccgcgaacctgcacctgtccgttctgcgcgatgtttctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 30 - DNA, 1884 bp, Artificial Sequence
  Synthetic
atggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgagattcctctgctgactgtatacgtacaggctgccaacctgcatctttctctgttacgcgacgcggtgtatttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccctgtcatcaacattaccgactatcgtgttggtccgtctttcgaaaacatcgaaaactctgcaatccgttccccgcacctgatggattttctgaacaacctgaccattgacaccgatctgatccgtggcgtgcactactgggctggtcaccgtgttacgtcccacttcactggctccagccaggtgatcacgactccacagtacggcattactgcgaacgcggaaccacgccgcaccatcgctccgtccacgttcccgggtctgaacctgttctaccgcactctgagcaacccgtttttccgtcgttctgaaaacatcactccaaccctgggtatcaacgtagttcagggtgtcggcttcattcagccgaacaacgctgaagtactgtaccgttcccgtggcaccgtagatagcctgaatgaactgccaattgatggtgagaactctctggtgggttacagccaccgcctgtcccatgtaacgctgacccgcagcctgtacaataccaacatcaccagcctgccgactttcgtgtggactcatcattctgcgaccaacaccaacactattaacccggacattatcacccagatcccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagaaataa

SEQ ID NO: 31 - DNA, 1830 bp, Artificial Sequence
  Synthetic
atgccaatcaacaaccagaaacagtgcatcccatacaattgcctgagtaatcctgaggaggttttactggacggcgaacgtatcctgccggacattgacccactggaagtgagcctgtcactgttacaattcttgctgaataatttcgtgccgggtggtggcttcatctctggattggtggataaaatctggggtgcccttcgtccgagcgaatgggatctgtttttagcgcagatcgaacagctgattaacgaacgtatcgccgaattcgcgcgtaacgccgcaattgcaaacctggaaggtctgggtaacaacttcaatatttatgttgaagcgttcaaagaatgggaagaagaccctaacaacccggaaacccgtacgcgcgttatcgaccgtttccgtattctggatggcctgctggaacgtgatatcccatctttccgcatttctggttttgaagtgccgctgctgtctgtttacgcccaggccgcgaacctgcatctggcgcttctgcgtgattccgtaatttttggcgaacgttggggtctgacgaccaagaacgttaatgacatttacaaccggcagatccgcgagattcacgagtattcaaaccactgtgtggatacgtacaacacagaactggaacgtttgggcttccgctctattgcccagtggcgtatctacaatcaatttcggcgggagttaacattgacggttctggacattgtggccctgtttccaaattatgatagccgcctgtatcctatccagactttcagtcagttaacccgcgaaatcgtgacatccccagtctcagagttctattatggcgttattaactccgggaacatcattggcaccctgactgaacagcagatccgtcgtccacacctgatggactttttcaacagcatgattatgtatacgtcggataaccgtcgcgagcactactggtcaggcctggaaatgacggcatactttactggattcgctggcgcccaagtaagttttccgcttgtaggcacccgtggcgagtctgctcctcccctgacggtgcgcagcgttaatgatggaatttaccgcattttatcagctccattctattcagctccgtttctgggaaccatcgtcctggggtcgcggggcgaaaaattcgatttcgcgttaaataatattagccctccgcctagcacaatttatcgtcacccaggtaccgttgacagtctggtcagcatcccgcctcaggataattcggttccgccgcaccgcggctcatcccatcggctgagtcacgttactatgcgtgcaagttcgcctatctttcattggacccatcgttccgccaccactacgaacaccattaacccgaacgcgattattcagattccgttggtgaaggcgttcaaccttcactcgggcgcgacagtggtacgcgggcccggtttcaccgggggcgatatcctgcgccgtacgaacactggtacgttcgcggatatgcgcgttaacatcactggcccgttgtcgcagcggtaccgtgtgcgtatccgctacgcctccacaacggatctgcagttctttacccgtatcaatggtacatcggtgaatcaggggaacttccagcgcacgatgaatcggggtgataaccttgagagcggcaactttcgtaccgccggcttctcgacaccgttttcgttttctaacgcgcagtctacttttacgctgggcacccaagcgtttagcaaccaggaagtttatatcgaccgtatcgagtttgtgccagccgaagtaacctttgaggcagaaagtgatctggaacgtgcgcaaaaataa

SEQ ID NO: 32 - DNA, 1833 bp, Artificial Sequence
  Synthetic
atgccaatcaacaaccagaaccagtgcatcccatacaattgcctgagtaatcctgaggaggttttcctggacggcgaacgtatcctgccggacattgacccactggaagtgagcctgtcactgttacaattcttgctgaataatttcgtgccgggtggtggcttcatctctggattgctggataaaatctggggtgcccttcgtccgagcgattgggaactgtttttagagcagatcgaacagctgattaacgaacgtatcgccgaattcgcgcgtaacgccgcaattgcaaacctggaaggtctgggtaacaacttcaatatttatgttgaagcgttcaaagaatgggaagaagaccctaacaacccggaaacccgtacgcgcgttatcgaccgtttccgtattctggatggcctgctggaacgtgatatcccatctttccgcatttctggttttgaagtgccgctgctgtctgtttacgcccaggccgcgaacctgcatctggcgcttctgcgtgattccgtagtgtttggcgaacgttggggtctgacgaccaccaacgttaatgacatttacaaccgacaggtgaaccgcattggcgagtattcaaaacactgtgtggatacgtacaagacagaactggaacgtttgggcttccgctctattgcccagtggcgtatctacaatcaatttcggcgggagttaacattgacggttctggacattgtggccgtttttccaaattatgatagccgcctgtatcctatccgcactattagtcagctgacgcgtgaaatttataccagcccagtgtcggagttctactacggtgtgatcaattctaacaatatcattgggacgcttacggaacagcagatccggcggccgcacctgatggatttcttcaactcaatgatcatgtatacctcagataaccgtcgtgaacactattggtcgggtttagagatgacggcgaccaacaccgaaggccatcaacgcagttttcctcttgcagggaccattgggaatagtgcacctccagtcactgttcgtaacaatggtgaaggtatctaccgtattctttctgagcccttttactctgcacctttcctgggtaccagcgtgctgggcagccgtggtgaggaatttgctttcgcgtctaacactactacaagtttgccgagtaccatttaccgcaaccgtggaactgttgattctcttgtatcaattccaccacaggattatagcgtgcctcctcatcgtggctactcgcacttgttgagtcatgttacgatgcgtaactcaagcccgatttttcattggattcaccgcagcgcgacgcctcgcaacacgatcgacccagatagtatcacacagattccggcagtcaagggggcatatattttcaattcgccggtgattacaggcccgggtcatacgggtggtgatattatccgtttcaacccgaatacgcagaataacattcgtatccccttccagtcgaacgccgtgcaacgttatcgcattcggatgcgttacgctgccgaggcagactgtatcctggagtcaggtgtgaacatcgtcacaggggccggggtgacctttcgtcctattccgattaaagccaccatgaccccgggctcgcctctgacctactatagtttccaatacgctgatctgaacatcaacctgaccgcgccgattcgccctaataactttgtgagtattcggcgcagtaatcagccaggtaatctgtatattgatcgtattgaattcatcccgattgatccaatccgtgaggctgaacatgacctggaacgtgcgcagaaataa

SEQ ID NO: 33 - DNA, 1827 bp, Artificial Sequence
  Synthetic
atgccaatcaacaaccagaaccagtgcatcccatacaattgcctgagtaatcctgaggaggttttcctggacggcgaacgtatcctgccggacattgacccactggaagtgagcctgtcactgttacaattcttgctgaataatttcgtgccgggtggtggcttcatctctggattgctggataaaatctggggtgcccttcgtccgagcgattgggaactgtttttagagcagatcgaacagctgattaacgaacgtatcgccgaattcgcgcgtaacgccgcaattgcaaacctggaaggtctgggtaacaacttcaatatttatgttgaagcgttcaaagaatgggaagaagaccctaacaacccggaaacccgtacgcgcgttatcgaccgtttccgtattctggatggcctgctggaacgtgatatcccatctttccgcatttctggttttgaagtgccgctgctgtctgtttacgcccaggccgcgaacctgcatctggcgcttctgcgtgattccgtagtgtttggcgaacgttggggtctgacgaccaccaacgttaatgacatttacaaccgacaggtgaaccgcattggcgagtattcaaaacactgtgtggatacgtacaagacagaactggaacgtttgggcttccgctctattgcccagtggcgtatctacaatcaatttcggcgggagttaacattgacggttctggacattgtggccgtttttccaaattatgatagccgcctgtatcctatccgcactattagtcagctgacgcgtgaaatttataccagcccagtgtcggagttctactacggtgtgatcaattctaacaatatcattgggacgcttacggaacagcagatccggcggccgcacctgatggatttcttcaactcaatgatcatgtatacctcagataaccgtcgtgaacactattggtcgggtttagagatgacggcgaccaacaccgaaggccatcaacgcagttttcctcttgcagggaccattgggaatagtgcacctccagtcactgttcgtaacaatggtgaaggtatctaccgtattctttctgagcccttttactctgcacctttcctgggtaccagcgtgctgggcagccgtggtgaggaatttgctttcgcgtctaacactactacaagtttgccgagtaccatttaccgcaaccgtggaactgttgattctcttgtatcaattccaccacaggattatagcgtgcctcctcatcgtggctactcgcacttgttgagtcatgttacgatgcgtaactcaagcccgatttttcattggattcaccgcagcgcgacgcctcgcaacacgatcgacccagatagtatcacacagattccgctggttaaagcgcataccctgcaatccggcaccactgtagtacgtggtcctggtttcaccggtggtgatattctgcgccgtacgagcggcggtccgtttgcgtacactatcgttaacattaatggtcagctgccgcagcgttatcgcgcgcgcatccgctacgcttctactacgaacctgcgcatctacgttaccgtagcaggtgaacgtattttcgctggtcagttcaacaaaactatggacactggcgacccgctgacgttccagtctttctcctatgccactattaacaccgcttttactttcccgatgtcccaatcttctttcactgtaggcgccgacactttttctagcggcaacgaggtgtacatcgaccgttttgaactgatccctgtaacggcgactttcgaagctgaatacgacctggaacgtgcacagaaataa

SEQ ID NO: 34 - DNA, 1833 bp, Artificial Sequence
  Synthetic
atgccaatcaacaaccagaaccagtgcatcccatacaattgcctgagtaatcctgaggaggttttcctggacggcgaacgtatcctgccggacattgacccactggaagtgagcctgtcactgttacaattcttgctgaataatttcgtgccgggtggtggcttcatctctggattgctggataaaatctggggtgcccttcgtccgagcgattgggaactgtttttagagcagatcgaacagctgattaaccagcgtatcgaagaattcgcgcgtaaccaggcaatctcccgtctggaaggtctgtccaacctgtaccagatctacgcagagtccttccgtgaatgggaagctgaccctaacaacccggaaacccgtacgcgcgttatcgaccgtttccgtattctggatggcctgctggaacgtgatatcccatctttccgcatttctggttttgaagtgccgctgctgtctgtttacgcccaggccgcgaacctgcatctggcgcttctgcgtgattccgtagtgtttggcgaacgttggggtctgacgaccaccaacgttaatgacatttacaaccgacaggtgaaccgcattggcgagtattcaaaacactgtgtggatacgtacaagacagaactggaacgtttgggcttccgctctattgcccagtggcgtatctacaatcaatttcggcgggagttaacattgacggttctggacattgtggccgtttttccaaattatgatagccgcctgtatcctatccgcactattagtcagctgacgcgtgaaatttataccagcccagtgtcggagttctactacggtgtgatcaattctaacaatatcattgggacgcttacggaacagcagatccggcggccgcacctgatggatttcttcaactcaatgatcatgtatacctcagataaccgtcgtgaacactattggtcgggtttagagatgacggcgaccaacaccgaaggccatcaacgcagttttcctcttgcagggaccattgggaatagtgcacctccagtcactgttcgtaacaatggtgaaggtatctaccgtattctttctgagcccttttactctgcacctttcctgggtaccagcgtgctgggcagccgtggtgaggaatttgctttcgcgtctaacactactacaagtttgccgagtaccatttaccgcaaccgtggaactgttgattctcttgtatcaattccaccacaggattatagcgtgcctcctcatcgtggctactcgcacttgttgagtcatgttacgatgcgtaactcaagcccgatttttcattggattcaccgcagcgcgacgcctcgcaacacgatcgacccagatagtatcacacagattccggcagtcaagggggcatatattttcaattcgccggtgattacaggcccgggtcatacgggtggtgatattatccgtttcaacccgaatacgcagaataacattcgtatccccttccagtcgaacgccgtgcaacgttatcgcattcggatgcgttacgctgccgaggcagactgtatcctggagtcaggtgtgaacatcgtcacaggggccggggtgacctttcgtcctattccgattaaagccaccatgaccccgggctcgcctctgacctactatagtttccaatacgctgatctgaacatcaacctgaccgcgccgattcgccctaataactttgtgagtattcggcgcagtaatcagccaggtaatctgtatattgatcgtattgaattcatcccgattgatccaatccgtgaggctgaacatgacctggaacgtgcgcagaaataa

SEQ ID NO: 35 - DNA, 1833 bp, Artificial Sequence
  Synthetic
atgccaatcaacaaccagaaccagtgcatcccatacaattgcctgagtaatcctgaggaggttttcctggacggcgaacgtatcctgccggacattgacccactggaagtgagcctgtcactgttacaattcttgctgaataatttcgtgccgggtggtggcttcatctctggattgctggataaaatctggggtgcccttcgtccgagcgattgggaactgtttttagagcagatcgaacagctgatcgaccgtcgcattgagcgtacagttcgtgcgaaagcgattgccgagctggagggcctgggccggagttaccagctgtacggtgaagccttcaaagagtgggaaaaagaccctaacaacccggaaacccgtacgcgcgttatcgaccgtttccgtattctggatggcctgctggaacgtgatatcccatctttccgcatttctggttttgaagtgccgctgctgtctgtttacgcccaggccgcgaacctgcatctggcgcttctgcgtgattccgtagtgtttggcgaacgttggggtctgacgaccaccaacgttaatgacatttacaaccgacaggtgaaccgcattggcgagtattcaaaacactgtgtggatacgtacaagacagaactggaacgtttgggcttccgctctattgcccagtggcgtatctacaatcaatttcggcgggagttaacattgacggttctggacattgtggccgtttttccaaattatgatagccgcctgtatcctatccgcactattagtcagctgacgcgtgaaatttataccagcccagtgtcggagttctactacggtgtgatcaattctaacaatatcattgggacgcttacggaacagcagatccggcggccgcacctgatggatttcttcaactcaatgatcatgtatacctcagataaccgtcgtgaacactattggtcgggtttagagatgacggcgaccaacaccgaaggccatcaacgcagttttcctcttgcagggaccattgggaatagtgcacctccagtcactgttcgtaacaatggtgaaggtatctaccgtattctttctgagcccttttactctgcacctttcctgggtaccagcgtgctgggcagccgtggtgaggaatttgctttcgcgtctaacactactacaagtttgccgagtaccatttaccgcaaccgtggaactgttgattctcttgtatcaattccaccacaggattatagcgtgcctcctcatcgtggctactcgcacttgttgagtcatgttacgatgcgtaactcaagcccgatttttcattggattcaccgcagcgcgacgcctcgcaacacgatcgacccagatagtatcacacagattccggcagtcaagggggcatatattttcaattcgccggtgattacaggcccgggtcatacgggtggtgatattatccgtttcaacccgaatacgcagaataacattcgtatccccttccagtcgaacgccgtgcaacgttatcgcattcggatgcgttacgctgccgaggcagactgtatcctggagtcaggtgtgaacatcgtcacaggggccggggtgacctttcgtcctattccgattaaagccaccatgaccccgggctcgcctctgacctactatagtttccaatacgctgatctgaacatcaacctgaccgcgccgattcgccctaataactttgtgagtattcggcgcagtaatcagccaggtaatctgtatattgatcgtattgaattcatcccgattgatccaatccgtgaggctgaacatgacctggaacgtgcgcagaaataa

SEQ ID NO: 36 - DNA, 1833 bp, Artificial Sequence
  Synthetic
atgccaatcaacaaccagaaccagtgcatcccatacaattgcctgagtaatcctgaggaggttttcctggacggcgaacgtatcctgccggacattgacccactggaagtgagcctgtcactgttacaattcttgctgaataatttcgtgccgggtggtggcttcatctctggattgctggataaaatctggggtgcccttcgtccgagcgattgggaactgtttttagagcagatcgaacagctgattaacgaacgtatcgccgaattcgcgcgtaacgccgcaattgcaaacctggaaggtctgggtaacaacttcaatatttatgttgaagcgttcaaagaatgggaagaagaccctaacaacccggaaacccgtacgcgcgttatcgaccgtttccgtattctggatggcctgctggaacgtgatatcccatctttccgcatttctggttttgaagtacagctgctgtctgtgtttgcgcaggcggctaacctgcacctgtccctgctgcgtgacgttgttttcttcggcgaacgttggggtctgacgaccaccaacgttaatgacatttacaaccgacaggtgaaccgcattggcgagtattcaaaacactgtgtggatacgtacaagacagaactggaacgtttgggcttccgctctattgcccagtggcgtatctacaatcaatttcggcgggagttaacattgacggttctggacattgtggccgtttttccaaattatgatagccgcctgtatcctatccgcactattagtcagctgacgcgtgaaatttataccagcccagtgtcggagttctactacggtgtgatcaattctaacaatatcattgggacgcttacggaacagcagatccggcggccgcacctgatggatttcttcaactcaatgatcatgtatacctcagataaccgtcgtgaacactattggtcgggtttagagatgacggcgaccaacaccgaaggccatcaacgcagttttcctcttgcagggaccattgggaatagtgcacctccagtcactgttcgtaacaatggtgaaggtatctaccgtattctttctgagcccttttactctgcacctttcctgggtaccagcgtgctgggcagccgtggtgaggaatttgctttcgcgtctaacactactacaagtttgccgagtaccatttaccgcaaccgtggaactgttgattctcttgtatcaattccaccacaggattatagcgtgcctcctcatcgtggctactcgcacttgttgagtcatgttacgatgcgtaactcaagcccgatttttcattggattcaccgcagcgcgacgcctcgcaacacgatcgacccagatagtatcacacagattccggcagtcaagggggcatatattttcaattcgccggtgattacaggcccgggtcatacgggtggtgatattatccgtttcaacccgaatacgcagaataacattcgtatccccttccagtcgaacgccgtgcaacgttatcgcattcggatgcgttacgctgccgaggcagactgtatcctggagtcaggtgtgaacatcgtcacaggggccggggtgacctttcgtcctattccgattaaagccaccatgaccccgggctcgcctctgacctactatagtttccaatacgctgatctgaacatcaacctgaccgcgccgattcgccctaataactttgtgagtattcggcgcagtaatcagccaggtaatctgtatattgatcgtattgaattcatcccgattgatccaatccgtgaggctgaacatgacctggaacgtgcgcagaaataa

SEQ ID NO: 37 - DNA, 1833 bp, Artificial Sequence
  Synthetic
atgccaatcaacaaccagaaccagtgcatcccatacaattgcctgagtaatcctgaggaggttttcctggacggcgaacgtatcctgccggacattgacccactggaagtgagcctgtcactgttacaattcttgctgaataatttcgtgccgggtggtggcttcatctctggattgctggataaaatctggggtgcccttcgtccgagcgattgggaactgtttttagagcagatcgaacagctgattaacgaacgtatcgccgaattcgcgcgtaacgccgcaattgcaaacctggaaggtctgggtaacaacttcaatatttatgttgaagcgttcaaagaatgggaagaagaccctaacaacccggaaacccgtacgcgcgttatcgaccgtttccgtattctggatggcctgctggaacgtgatatcccatctttccgcatttctggttttcaagtgcctttcctgagcgtgtacgtgcaagcggccaacctgcacctgtccgtactgcgtgacgtgtctgttttcggcgaacgttggggtctgacgaccaccaacgttaatgacatttacaaccgacaggtgaaccgcattggcgagtattcaaaacactgtgtggatacgtacaagacagaactggaacgtttgggcttccgctctattgcccagtggcgtatctacaatcaatttcggcgggagttaacattgacggttctggacattgtggccgtttttccaaattatgatagccgcctgtatcctatccgcactattagtcagctgacgcgtgaaatttataccagcccagtgtcggagttctactacggtgtgatcaattctaacaatatcattgggacgcttacggaacagcagatccggcggccgcacctgatggatttcttcaactcaatgatcatgtatacctcagataaccgtcgtgaacactattggtcgggtttagagatgacggcgaccaacaccgaaggccatcaacgcagttttcctcttgcagggaccattgggaatagtgcacctccagtcactgttcgtaacaatggtgaaggtatctaccgtattctttctgagcccttttactctgcacctttcctgggtaccagcgtgctgggcagccgtggtgaggaatttgctttcgcgtctaacactactacaagtttgccgagtaccatttaccgcaaccgtggaactgttgattctcttgtatcaattccaccacaggattatagcgtgcctcctcatcgtggctactcgcacttgttgagtcatgttacgatgcgtaactcaagcccgatttttcattggattcaccgcagcgcgacgcctcgcaacacgatcgacccagatagtatcacacagattccggcagtcaagggggcatatattttcaattcgccggtgattacaggcccgggtcatacgggtggtgatattatccgtttcaacccgaatacgcagaataacattcgtatccccttccagtcgaacgccgtgcaacgttatcgcattcggatgcgttacgctgccgaggcagactgtatcctggagtcaggtgtgaacatcgtcacaggggccggggtgacctttcgtcctattccgattaaagccaccatgaccccgggctcgcctctgacctactatagtttccaatacgctgatctgaacatcaacctgaccgcgccgattcgccctaataactttgtgagtattcggcgcagtaatcagccaggtaatctgtatattgatcgtattgaattcatcccgattgatccaatccgtgaggctgaacatgacctggaacgtgcgcagaaataa

SEQ ID NO: 38 - DNA, 1833 bp, Artificial Sequence
  Synthetic
atgccaatcaacaaccagaaccagtgcatcccatacaattgcctgagtaatcctgaggaggttttcctggacggcgaacgtatcctgccggacattgacccactggaagtgagcctgtcactgttacaattcttgctgaataatttcgtgccgggtggtggcttcatctctggattgctggataaaatctggggtgcccttcgtccgagcgattgggaactgtttttagagcagatcgaacagctgattaacgaacgtatcgccgaattcgcgcgtaacgccgcaattgcaaacctggaaggtctgggtaacaacttcaatatttatgttgaagcgttcaaagaatgggaagaagaccctaacaacccggaaacccgtacgcgcgttatcgaccgtttccgtattctggatggcctgctggaacgtgatatcccatctttccgcatttctggttttgaggtgccgctgctgctggtttacacgcaggctgcgaacctgcatttggcattactgcgtgactctgtggtcttcggcgaacgttggggtctgacgaccaccaacgttaatgacatttacaaccgacaggtgaaccgcattggcgagtattcaaaacactgtgtggatacgtacaagacagaactggaacgtttgggcttccgctctattgcccagtggcgtatctacaatcaatttcggcgggagttaacattgacggttctggacattgtggccgtttttccaaattatgatagccgcctgtatcctatccgcactattagtcagctgacgcgtgaaatttataccagcccagtgtcggagttctactacggtgtgatcaattctaacaatatcattgggacgcttacggaacagcagatccggcggccgcacctgatggatttcttcaactcaatgatcatgtatacctcagataaccgtcgtgaacactattggtcgggtttagagatgacggcgaccaacaccgaaggccatcaacgcagttttcctcttgcagggaccattgggaatagtgcacctccagtcactgttcgtaacaatggtgaaggtatctaccgtattctttctgagcccttttactctgcacctttcctgggtaccagcgtgctgggcagccgtggtgaggaatttgctttcgcgtctaacactactacaagtttgccgagtaccatttaccgcaaccgtggaactgttgattctcttgtatcaattccaccacaggattatagcgtgcctcctcatcgtggctactcgcacttgttgagtcatgttacgatgcgtaactcaagcccgatttttcattggattcaccgcagcgcgacgcctcgcaacacgatcgacccagatagtatcacacagattccggcagtcaagggggcatatattttcaattcgccggtgattacaggcccgggtcatacgggtggtgatattatccgtttcaacccgaatacgcagaataacattcgtatccccttccagtcgaacgccgtgcaacgttatcgcattcggatgcgttacgctgccgaggcagactgtatcctggagtcaggtgtgaacatcgtcacaggggccggggtgacctttcgtcctattccgattaaagccaccatgaccccgggctcgcctctgacctactatagtttccaatacgctgatctgaacatcaacctgaccgcgccgattcgccctaataactttgtgagtattcggcgcagtaatcagccaggtaatctgtatattgatcgtattgaattcatcccgattgatccaatccgtgaggctgaacatgacctggaacgtgcgcagaaataa

SEQ ID NO: 39 - DNA, 1833 bp, Artificial Sequence
  Synthetic
atgccaatcaacaaccagaaccagtgcatcccatacaattgcctgagtaatcctgaggaggttttcctggacggcgaacgtatcctgccggacattgacccactggaagtgagcctgtcactgttacaattcttgctgaataatttcgtgccgggtggtggcttcatctctggattgctggataaaatctggggtgcccttcgtccgagcgattgggaactgtttttagagcagatcgaacagctgattaacgaacgtatcgccgaattcgcgcgtaacgccgcaattgcaaacctggaaggtctgggtaacaacttcaatatttatgttgaagcgttcaaagaatgggaagaagaccctaacaacccggaaacccgtacgcgcgttatcgaccgtttccgtattctggatggcctgctggaacgtgatatcccatctttccgcatttctggttttgaggtgccgctgctgtccgtttacacgcaggctgcgaacctgcatttggcattactgcgtgactctgtgattttcggcgaacgttggggtctgacgaccaccaacgttaatgacatttacaaccgacaggtgaaccgcattggcgagtattcaaaacactgtgtggatacgtacaagacagaactggaacgtttgggcttccgctctattgcccagtggcgtatctacaatcaatttcggcgggagttaacattgacggttctggacattgtggccgtttttccaaattatgatagccgcctgtatcctatccgcactattagtcagctgacgcgtgaaatttataccagcccagtgtcggagttctactacggtgtgatcaattctaacaatatcattgggacgcttacggaacagcagatccggcggccgcacctgatggatttcttcaactcaatgatcatgtatacctcagataaccgtcgtgaacactattggtcgggtttagagatgacggcgaccaacaccgaaggccatcaacgcagttttcctcttgcagggaccattgggaatagtgcacctccagtcactgttcgtaacaatggtgaaggtatctaccgtattctttctgagcccttttactctgcacctttcctgggtaccagcgtgctgggcagccgtggtgaggaatttgctttcgcgtctaacactactacaagtttgccgagtaccatttaccgcaaccgtggaactgttgattctcttgtatcaattccaccacaggattatagcgtgcctcctcatcgtggctactcgcacttgttgagtcatgttacgatgcgtaactcaagcccgatttttcattggattcaccgcagcgcgacgcctcgcaacacgatcgacccagatagtatcacacagattccggcagtcaagggggcatatattttcaattcgccggtgattacaggcccgggtcatacgggtggtgatattatccgtttcaacccgaatacgcagaataacattcgtatccccttccagtcgaacgccgtgcaacgttatcgcattcggatgcgttacgctgccgaggcagactgtatcctggagtcaggtgtgaacatcgtcacaggggccggggtgacctttcgtcctattccgattaaagccaccatgaccccgggctcgcctctgacctactatagtttccaatacgctgatctgaacatcaacctgaccgcgccgattcgccctaataactttgtgagtattcggcgcagtaatcagccaggtaatctgtatattgatcgtattgaattcatcccgattgatccaatccgtgaggctgaacatgacctggaacgtgcgcagaaataa

SEQ ID NO: 40 - DNA, 1839 bp, Artificial Sequence
  Synthetic
atgccctcaaatgaacatgattatttgaaagtttgtgatgatttaagtgaaactaatatggagaggtttgacaaaaatgatgcactggagattggtatgtctattgtatctgaacttcttggcatgattccaggcggagcagccttacaatttgtgtttaatcaattgtggtcgcgtttaggtgattctggatggagtgcattcatggaacatgttgaagaattaattgatactaaaatagaagggtatgcaaaaaataaagccttatctgagttagcaggtatgcacagaaatcttgaaacatatataaaattgcttaatgaatgggaaaataatactggaagttcaaaagcacaaggtagagtagctaattattttgaaagtcttgagcaggcggttgaaagaggtatgcctcaattcgcagttggtaatttcgaaataccccttttaactgtttatgtacaagctgctaaccttcatttattgttattaagagatgtttcagtttatggaaaacgctggggatggtcagatcagaaaattaagatttattatgagaaacaagttaagtatactcatgaatacaccaatcattgttcgacttggtataatagaggactagataaattgaaaaataagggttcttcttaccaagattggtacaactataatcgtttccgtagagaaattactcttactgttctagatatcgtcgctgtattcccacactatgatgtgaaagcatatccaattcaaacagttggccaattaacaagagaagtatatacagacccattaattaatttcaatccgcagttacagtctgtagctcaattgcctacttttaacgttatggaaagtaacgcaattagaaaccctcatttagttgacttcttgaataaccttagaatttttacagattggtttagtgtcggacggcactattattggggaggacatcgagtgatttccaaacgtgtaggaggaagggagataaccttccctatatatggaagggaggcaaagcaggaacctccaagatcctttacttttaatggacctgtttttaggacgttatcaaatcctaccctaagaccattacaacaacctgcaccagctcctccttttaatttacgtggcttggaaggtgtaaaattttatacacctacaaatacctttacgtatcggggaagaggcccgcgtgattctttaactgaattaccgcctggagatacaagtgtactacctcgcgaaggatattctcaccgcctgtgtcatgccacgtttgttcagcgttctggtaccccgttcctgaccaccggtccggtattctcttggactcatcgctctgcgaccgatcgcaacatcatttacccggacgttatcaaccaaatcccgctggtgaaggcgtttaacctgacctctggcacttccgtagtgcgtggtccgggtttcacgggtggcgatattattcgtactaacgtgaacggcagcgtcctgtccatgtccctgaacttcagcaacactactctgcagcgctaccgcgttcgcgttcgttacgccgcatctcagactatggtgatgtccgtcaccgttggcggttccaccaccggcaaccagggtttcccatctaccatgtctgccaatggcgcgctgacctcccagagcttccgtttcgcagaatttccggtaggcatctctgcttctggttctcagggtgcgtccatttctatcagcaacaacgtaggccgtcagatgttccatctggaccgcatcgaatttctgccggtgacctccaccttcgaagaagaatacgatctggaacgtgcgcaagaataa

SEQ ID NO: 41 - DNA, 1839 bp, Artificial Sequence
  Synthetic
atgccctcaaatgaacatgattatttgaaagtttgtgatgatttaagtgaaactaatatggagaggtttgacaaaaatgatgcactggagattggtatgtctattgtatctgaacttcttggcatgattccaggcggagcagccttacaatttgtgtttaatcaattgtggtcgcgtttaggtgattctggatggagtgcattcatggaacatgttgaagaattaattgatactaaaatagaagggtatgcaaaaaataaagccttatctgagttagcaggtatgcacagaaatcttgaaacatatataaaattgcttaatgaatgggaaaataatactggaagttcaaaagcacaaggtagagtagctaattattttgaaagtcttgagcaggcggttgaaagaggtatgcctcaattcgcagttggtaatttcgaaataccccttttaactgtttatgtacaagctgctaaccttcatttattgttattaagagatgtttcagtttatggaaaacgctggggatggtcagatcagaaaattaagatttattatgagaaacaagttaagtatactcatgaatacaccaatcattgttcgacttggtataatagaggactagataaattgaaaaataagggttcttcttaccaagattggtacaactataatcgtttccgtagagaaattactcttactgttctagatatcgtcgctgtattcccacactatgatgtgaaagcatatccaattcaaacagttggccaattaacaagagaagtatatacagacccattaattaatttcaatccgcagttacagtctgtagctcaattgcctacttttaacgttatggaaagtaacgcaattagaaaccctcatttagttgacttcttgaataaccttagaatttttacagattggtttagtgtcggacggcactattattggggaggacatcgagtgatttccaaacgtgtaggaggaagggagataaccttccctatatatggaagggaggcaaagcaggaacctccaagatcctttacttttaatggacctgtttttaggacgttatcaaatcctaccctaagaccattacaacaacctgcaccagctcctccttttaatttacgtggcttggaaggtgtaaaattttatacacctacaaatacctttacgtatcggggaagaggcccgcgtgattctttaactgaattaccgcctggagatacaagtgtactacctcgcgaaggatatagtcaccggttatgtcatgcaacatttattcaaagatctggcacaccttttttaacaacaggcgtagtcttttcttggactcatcgttctgcgaccgatcgcaacatcatttacccggacgttatcaaccaaatcccgctggtgaaggcgtttaacctgacctctggcacttccgtagtgcgtggtccgggtttcacgggtggcgatattattcgtactaacgtgaacggcagcgtcctgtccatgtccctgaacttcagcaacactactctgcagcgctaccgcgttcgcgttcgttacgccgcatctcagactatggtgatgtccgtcaccgttggcggttccaccaccggcaaccagggtttcccatctaccatgtctgccaatggcgcgctgacctcccagagcttccgtttcgcagaatttccggtaggcatctctgcttctggttctcagggtgcgtccatttctatcagcaacaacgtaggccgtcagatgttccatctggaccgcatcgaatttctgccggtgacctccaccttcgaagaagaatacgatctggaacgtgcgcaagaataa

SEQ ID NO: 42 - DNA, 1827 bp, Artificial Sequence
  Synthetic
atgccctcaaatgaacatgattatttgaaagtttgtgatgatttaagtgaaactaatatggagaggtttgacaaaaatgatgcactggagattggtatgtctattgtatctgaacttcttggcatgattccaggcggagcagccttacaatttgtgtttaatcaattgtggtcgcgtttaggtgattctggatggagtgcattcatggaacatgttgaagaattaattgatactaaaatagaagggtatgcaaaaaataaagccttatctgagttagcaggtatgcacagaaatcttgaaacatatataaaattgcttaatgaatgggaaaataatactggaagttcaaaagcacaaggtagagtagctaattattttgaaagtcttgagcaggcggttgaaagaggtatgcctcaattcgcagttggtaatttcgaaataccccttttaactgtttatgtacaagctgctaaccttcatttattgttattaagagatgtttcagtttatggaaaacgctggggatggtcagatcagaaaattaagatttattatgagaaacaagttaagtatactcatgaatacaccaatcattgttcgacttggtataatagaggactagataaattgaaaaataagggttcttcttaccaagattggtacaactataatcgtttccgtagagaaattactcttactgttctagatatcgtcgctgtattcccacactatgatgtgaaagcatatccaattcaaacagttggccaattaacaagagaagtatatacagacccattaattaatttcaatccgcagttacagtctgtagctcaattgcctacttttaacgttatggaaagtaacgcaattagaaaccctcatttagttgacttcttgaataaccttagaatttttacagattggtttagtgtcggacggcactattattggggaggacatcgagtgatttccaaacgtgtaggaggaagggagataaccttccctatatatggaagggaggcaaagcaggaacctccaagatcctttacttttaatggacctgtttttaggacgttatcaaatcctaccctaagaccattacaacaacctgcaccagctcctccttttaatttacgtggcttggaaggtgtaaaattttatacacctacaaatacctttacgtatcggggaagaggcccgcgtgattctttaactgaattaccgcctggagatacaagtgtactacctcgcgaaggatatagtcaccggttatgtcatgcaacatttattcaaagatctggcacaccttttttaacaacaggcgtagtcttttcttggactcatcgttctgcgtctccgaccaatgaggtgtctccgtcccgtattacccagattccgtgggttaaggcacacactctggcgtccggcgcctccgtgattaaaggccctggttttaccggtggtgacattctgacgcgtaactctatgggcgaactgggcactctgcgtgtcacgttcactggtcgtctgccgcagagctattacatccgtttccgctatgcatctgtcgcaaaccgttccggtaccttccgctattctcagccgccgagctacggcatctccttcccaaaaaccatggatgcgggtgaaccgctgacctctcgttctttcgcacacaccacgctgtttactcctattacgttttcccgtgctcaggaggagttcgatctgtacatccagtctggcgtatacatcgatcgtatcgagttcattccggtaacggccacctttgaagctgagtacgatctggaacgtgcgcagaaataa

SEQ ID NO: 43 - DNA, 1839 bp, Artificial Sequence
  Synthetic
atgccctcaaatgaacatgattatttgaaagtttgtgatgatttaagtgaaactaatatggagaggtttgacaaaaatgatgcactggagattggtatgtctattgtatctgaacttcttggcatgattccaggcggagcagccttacaatttgtgtttaatcaattgtggtcgcgtttaggtgattctggatggagtgcattcatggaacatgttgaagaattaattgatactaaaatagaagggtatgcaaaaaataaagccttatctgagttagcaggtatgcacagaaatcttgaaacatatataaaattgcttaatgaatgggaaaataatactggaagttcaaaagcacaaggtagagtagctaattattttgaaagtcttgagcaggcggttgaaagaggtatgcctcaattcgcagttggtaatttcgaaataccccttttaactgtttatgtacaagctgctaaccttcatttattgttattaagagatgtttcagtttatggaaaacgctggggatggtcagatcagaaaattaagatttattatgagaaacaagttaagtatactcatgaatacaccaatcattgttcgacttggtataatagaggactagataaattgaaaaataagggttcttcttaccaagattggtacaactataatcgtttccgtagagaaattactcttactgttctagatatcgtcgctgtattcccacactatgatgtgaaagcatatccaattcaaacagttggccaattaacaagagaagtatatacagacccattaattaatttcaatccgcagttacagtctgtagctcaattgcctacttttaacgttatggaaagtaacgcaattagaaaccctcatttagttgacttcttgaataaccttagaatttttacagattggtttagtgtcggacggcactattattggggaggacatcgagtgatttccaaacgtgtaggaggaagggagataaccttccctatatatggaagggaggcaaagcaggaacctccaagatcctttacttttaatggacctgtttttaggacgttatcaaatcctaccctaagaccattacaacaacctgcaccagctcctccttttaatttacgtggcttggaaggtgtaaaattttatacacctacaaatacctttacgtatcggggaagaggcccgcgtgattctttaactgaattaccgcctggagatacaagtgtactacctcgcgaaggatatagtcaccggttatgtcatgcaacatttattcaaagatctggcacaccttttttaacaacaggcgtagtcttttcttggacacatcgtagtgctgatgaaacgaatataatttatccagataagattactcaaattccactggttaagtctttcaacctgaactctggcacttccgttgtttccggtccgggtttcaccggtggtgatatcattcgcaccaacgttaatggctctgtgctgtccatgggcctgaattttaataacactagcctgcaacgctaccgtgtacgcgttcgctacgctgcttctcagaccatggtgctgcgtgtgacggttggcggttctaccactttcgaccagggtttcccgtccaccatgagcgcgaacgaatctctgacctctcagtctttccgtttcgcagaatttccggttggtatctctgcgtctggctctcagactgctggcatctccatctccaataacgcaggtcgtcagactttccattttgacaaaatcgaattcattccgatcaccgcaacctttgaagcagaatatgacctggaacgtgcgcaagaataa

SEQ ID NO: 44 - DNA, 1845 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccagccgttaaaggtaacttcctgtttaacggagctgtcatctcagggcctggatttaccggtggcgatcttgtccgccttaaccgcaacaatgataatattcaaaatcgcggttatattgaagttccgatccagttcgcctcgactagcacgcgttatcgcgtacgcgtccgttacgccagcactaatgcgattgaggtgaatattaactggggtaatggcagtattttcaccggaaccgccccagcaaccgcgacgagcctggataacctgcagagcaatgattttggttacttcgagagcaccacggcctttgccccttcgctggggaacattgtaggcgtgcgtaacttctctgctaatgccgatgtgatcattgatcgctttgagtttatccccgtaacggcaaccctggaagcggagtatgatctggaacgcgcggaaaaataa

SEQ ID NO: 45 - DNA, 1839 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccactggttaaggctctgaacctgcactctggcgttaccgttgttggtggtccgggtttcaccggtggtgatatcctgcgccgtacgaacaccggcactttcggcgacatccgcctgaatatcaatgtaccactgagccaacgctaccgtgtacgcattcgctacgcttccactaccgacctgcagttcttcactcgtatcaatggtaccaccgttaacatcggcaacttctctcgcaccatgaaccgtggtgataacctggaataccgctctttccgtaccgcaggtttttctacgccgtttaacttcctgaacgcccagtctactttcacgctgggcgcgcagtctttcagcaaccaggaagtctacattgaccgtgtggaattcgtgccggcggaagttacctttgaagcagaatatgacctggaacgtgcgcaaaaataa

SEQ ID NO: 46 - DNA, 1839 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgcgaccgatcgcaacatcatttacccggacgttatcaaccaaatcccgctggtgaaggcgtttaacctgacctctggcacttccgtagtgcgtggtccgggtttcacgggtggcgatattattcgtactaacgtgaacggcagcgtcctgtccatgtccctgaacttcagcaacactactctgcagcgctaccgcgttcgcgttcgttacgccgcatctcagactatggtgatgtccgtcaccgttggcggttccaccaccggcaaccagggtttcccatctaccatgtctgccaatggcgcgctgacctcccagagcttccgtttcgcagaatttccggtaggcatctctgcttctggttctcagggtgcgtccatttctatcagcaacaacgtaggccgtcagatgttccatctggaccgcatcgaatttctgccggtgacctccaccttcgaagaagaatacgatctggaacgtgcgcaagaataa

SEQ ID NO: 47 - DNA, 1839 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccactggtgaaggcgtttaacctgacctctggcacttccgtagtgcgtggtccgggtttcacgggtggcgatattattcgtactaacgtgaacggcagcgtcctgtccatgtccctgaacttcagcaacactactctgcagcgctaccgcgttcgcgttcgttacgccgcatctcagactatggtgatgtccgtcaccgttggcggttccaccaccggcaaccagggtttcccatctaccatgtctgccaatggcgcgctgacctcccagagcttccgtttcgcagaatttccggtaggcatctctgcttctggttctcagggtgcgtccatttctatcagcaacaacgtaggccgtcagatgttccatctggaccgcatcgaatttctgccggtgacctccaccttcgaagaagaatacgatctggaacgtgcgcaagaataa

SEQ ID NO: 48 - DNA, 1827 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccatgggttaaggcacacactctggcgtccggcgcctccgtgattaaaggccctggttttaccggtggtgacattctgacgcgtaactctatgggcgaactgggcactctgcgtgtcacgttcactggtcgtctgccgcagagctattacatccgtttccgctatgcatctgtcgcaaaccgttccggtaccttccgctattctcagccgccgagctacggcatctccttcccaaaaaccatggatgcgggtgaaccgctgacctctcgttctttcgcacacaccacgctgtttactcctattacgttttcccgtgctcaggaggagttcgatctgtacatccagtctggcgtatacatcgatcgtatcgagttcattccggtaacggccacctttgaagctgagtacgatctggaacgtgcgcagaaataa

SEQ ID NO: 49 - DNA, 1839 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgccaccacaactaacaccattaacccgaatgcaattatccagattccactggtgaaggcgttcaatctgcatagcggggcaaccgtggtgcgcggcccgggatttaccggcggcgatattctgcgccgcaccaatacggggacgtttgccgatatgcgtgttaacattaccggcccgctgagtcagcgctaccgcgtacgcatccgctacgccagcactaccgacctgcagttttttacacgcattaatggtacgtcggtgaatcagggcaatttccagcgtaccatgaaccgtggcgataatttagagagcggcaacttccggaccgcagggtttagcacgccgttttccttttcaaacgcgcagagtactttcacgcttggcacacaggctttttcaaatcaggaggtgtacattgaccgcatcgagtttgttccagctgaagtaacctttgaggccgaatctgatttggaacgcgcccagaagtaa

SEQ ID NO: 50 - DNA, 1839 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccactggtgaaggcgttcaatctgcatagcggggcaaccgtggtgcgcggcccgggatttaccggcggcgatattctgcgccgcaccaatacggggacgtttgccgatatgcgtgttaacattaccggcccgctgagtcagcgctaccgcgtacgcatccgctacgccagcactaccgacctgcagttttttacacgcattaatggtacgtcggtgaatcagggcaatttccagcgtaccatgaaccgtggcgataatttagagagcggcaacttccggaccgcagggtttagcacgccgttttccttttcaaacgcgcagagtactttcacgcttggcacacaggctttttcaaatcaggaggtgtacattgaccgcatcgagtttgttccagctgaagtaacctttgaggccgaatctgatttggaacgcgcccagaagtaa

SEQ ID NO: 51 - DNA, 1845 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgccgatcgcacgaacacgattgccaccaacattatcacccagatcccggcagtgaaaggcaactttctgtttaacggcagcgtgatcagcggtccaggttttaccggcggtgacctggtgcgcctgaacaacagcggcaacaatatccaaaaccgtggttatctggaagtcccgattcaattcatcagcacgagcacccgttaccgcgtccgtgttcgctacgcatccgttacgccgatccaactgagcgttaactggggcaattccaacattttcagcagcattgtccctgctacggcgacctctctggacaatttgcagagccgtgacttcggctatttcgaaagcaccaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaataa

SEQ ID NO: 52 - DNA, 1845 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccagcagtgaaaggcaactttctgtttaacggcagcgtgatcagcggtccaggttttaccggcggtgacctggtgcgcctgaacaacagcggcaacaatatccaaaaccgtggttatctggaagtcccgattcaattcatcagcacgagcacccgttaccgcgtccgtgttcgctacgcatccgttacgccgatccaactgagcgttaactggggcaattccaacattttcagcagcattgtccctgctacggcgacctctctggacaatttgcagagccgtgacttcggctatttcgaaagcaccaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaataa

SEQ ID NO: 53 - DNA, 1845 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccagccgttaaaggtaacttcctgtttaacggagctgtcatctcagggcctggatttaccggtggcgacctggtgcgcctgaacaacagcggcaacaatatccaaaaccgtggttatctggaagtcccgattcaattcatcagcacgagcacccgttaccgcgtccgtgttcgctacgcatccgttacgccgatccaactgagcgttaactggggcaattccaacattttcagcagcattgtccctgctacggcgacctctctggacaatttgcagagccgtgacttcggctatttcgaaagcaccaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaataa

SEQ ID NO: 54 - DNA, 1845 bp, Artificial Sequence
  Synthetic
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccagccgttaaaggtaacttcctgtttaacggagctgtcatctcagggcctggatttaccggtggcgatcttgtccgccttaaccgcaacaatgataatattcaaaatcgcggttatattgaagttccgatccagttcgcctcgactagcacgcgttatcgcgtacgcgtccgttacgccagcactacgccgatccaactgagcgttaactggggcaattccaacattttcagcagcattgtccctgctacggcgacctctctggacaatttgcagagccgtgacttcggctatttcgaaagcaccaacgctttcaccagcgctacgggcaatgtggttggtgttcgcaatttcagcgagaatgcgggcgtcatcattgaccgttttgagtttatcccggtgaccgcgaccttcgaagcggagtacgatctggagcgtgcgcaggaataa

SEQ ID NO: 55 - DNA, 1839 bp, Artificial Sequence; identical to SEQ ID NO: 45
  Synthetic

SEQ ID NO: 56 - DNA, 1830 bp, Artificial Sequence
  Synthetic
atgccctcaaatgaacatgattatttgaaagtttgtgatgatttaagtgaaactaatatggagaggtttgacaaaaatgatgcactggagattggtatgtctattgtatctgaacttcttggcatgattccaggcggagcagccttacaatttgtgtttaatcaattgtggtcgcgtttaggtgattctggatggagtgcattcatggaacatgttgaagaattaattgatactaaaatagaagggtatgcaaaaaataaagccttatctgagttagcaggtatgcacagaaatcttgaaacatatataaaattgcttaatgaatgggaaaataatactggaagttcaaaagcacaaggtagagtagctaattattttgaaagtcttgagcaggcggttgaaagaggtatgcctcaattcgcagttggtaatttcgaaataccccttttaactgtttatgtacaagctgctaaccttcatttattgttattaagagatgtttcagtttatggaaaacgctggggatggtcagatcagaaaattaagatttattatgagaaacaagttaagtatactcatgaatacaccaatcattgttcgacttggtataatagaggactagataaattgaaaaataagggttcttcttaccaagattggtacaactataatcgtttccgtagagaaattactcttactgttctagatatcgtcgctgtattcccacactatgatgtgaaagcatatccaattcaaacagttggccaattaacaagagaagtatatacagacccattaattaatttcaatccgcagttacagtctgtagctcaattgcctacttttaacgttatggaaagtaacgcaattagaaaccctcatttagttgacttcttgaataaccttagaatttttacagattggtttagtgtcggacggcactattattggggaggacatcgagtgatttccaaacgtgtaggaggaagggagataaccttccctatatatggaagggaggcaaagcaggaacctccaagatcctttacttttaatggacctgtttttaggacgttatcaaatcctaccctaagaccattacaacaacctgcaccagctcctccttttaatttacgtggcttggaaggtgtaaaattttatacacctacaaatacctttacgtatcggggaagaggcccgcgtgattctttaactgaattaccgcctggagatacaagtgtactacctcgcgaaggatatagtcaccggttatgtcatgcaacatttattcaaagatctggcacaccttttttaacaacaggcgtagtcttttcttggacacatcgtagtgctgatgaaacgaatataatttatccagataagattactcaaattccatgggtaaaggcgcatacccttgaatcgggggccactgttattaagggtcctggatttacaggaggggatattcttactgttcttactagtcttggttccttgggcgctttacgagtaacttttacggggcaattaccacaaacatataatatacgaatccgatatgcctcggtgctaaataaatatggtacactccatttttcacagccacctgcatatgggctcacatttccaaaaactatggatatagatgaaccattaacatctcgctcgtttgcttttacaactctttggacaccaataacctttacacgagcacaagaggaatttaatctaacaatacaatcaggtgtttatatagatagaattgaatttgttccggcagaagtaacatttgaggcagactatgacttggaaaaagcgcaaaagtaa

SEQ ID NO: 57 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 58 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 59 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNIIIDTDLIRGVHYWAGHRVTSHFTGSSQVISSPQYGITANAEPSRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 60 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSDNIMPTLGINVVQGVGFIQPNNGEVLYRRRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 61 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLQGLSNLYRIYTNAFKNWEVDPTNPALREEMRIQFNDMNSALTTAIPLFSVQGYEIPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 62 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 63 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLINQRIEEFARNQAISRLEGLSNLYQIYAEAFREWEADPTNPALTEEMRIQFNDMNSALTTAIPLFTVQNYQVPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 64 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 65 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLQGLSNLYRIYTNAFKNWEVDPTNPALREEMRIQFNDMNSALTTAIPLFSVQGYEIPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRLGGGTSVIKGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 66 - protein, 630 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLTNIIIDTDLIRGVYYWAGHRINSRFTGTAFPHIITSPQYGITANAEPRRTIAPGPFQGVPSLLYRTLSDPFFRRSDNISPTLGINVVQGVGFLQPNNFESLYRRRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 67 - protein, 624 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDVLNNLTIFTDWFSVGRNFYWGGHRVISNRIGGGNITSPIYGREANQEPPRSFTFNGPVFRTLSNPTFRPLQQPWPAPPFNLRGVEGVEFSTPLNSFTYRGRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 68 - protein, 615 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKAFNLSSGAAVVRGPGFTGGDILRRKNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQE

SEQ ID NO: 69 - protein, 615 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPVVKAYELSSGATVVKGPGFTGGDVIRRTNTGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKK

SEQ ID NO: 70 - protein, 617 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLTNIIIDTDLIRGVYYWAGHRINSRFTGTAFPHIITSPQYGITANAEPRRTIAPGPFQGVPSLLYRTLSDPFFRRSDNISPTLGINVVQGVGFLQPNNFESLYRRRGTVDSLNELPIDGENSLVGYSHRLSHVTLTRSLYNTNITSLPTFVWTHHSATDRNIIYPDVINQIPLVKAFNLTSGTSVVRGPGFTGGDIIRTNVNGSVLSMSLNFSNTTLQRYRVRVRYAASQTMVMSVTVGGSTTGNQGFPSTMSANGALTSQSFRFAEFPVGISASGSQGASISISNNVGRQMFHLDRIEFLPVTSTFEEEYDLERAQE

SEQ ID NO: 71 - protein, 618 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLTNIIIDTDLIRGVYYWAGHRINSRFTGTAFPHIITSPQYGITANAEPRRTIAPGPFQGVPSLLYRTLSDPFFRRSDNISPTLGINVVQGVGFLQPNNFESLYRRRGTVDSLNELPIDGENSLVGYSHRLSHVTLTRSLYNTNITSLPTFVWTHHSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGGNLQSGSFRTVGFTTPFNFSNGSSVFTLSAHVFNSGNEVYIDRIEFVPAEVTFEAEYDLERAQE

SEQ ID NO: 72 - protein, 614 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQK

SEQ ID NO: 73 - protein, 630 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLTNIIIDTDLIRGVYYWAGHRINSRFTGTAFPHIITSPQYGITANAEPRRTIAPGPFQGVPSLLYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 74 - protein, 630 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFIDRIVIYTNSVRSTPYWAGHEVISRRTGQGQGNEIRFPLYGVAANAEPPVTIRPTGFTDEQRQWYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 75 - protein, 630 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLTNIIIDTDLIRGVYYWAGHRINSRFTGTAFPHIITSPQYGITANAEPRRTIVPGPFQGVPSLLYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 76 - protein, 627 aa, Artificial Sequence; identical to SEQ ID NO: 59
  Synthetic

SEQ ID NO: 77 - protein, 627 aa, Artificial Sequence; identical to SEQ ID NO: 60
  Synthetic

SEQ ID NO: 78 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSDNISPTLGINVVQGVGFLQPNNFESLYRRRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 79 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLISQRIEEFARNQAISRLEGLSNLYKVYVRAFSDWEKDPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 80 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYQVPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 81 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPALTEEMRIQFNDMNSALTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 82 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYQVPLLSVYVQAVNLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 83 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEVALLSVYVQAANLHLSVLRDVSVYGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 84 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLSVYVQAANLHLSILRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 85 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 86 - protein, 627 aa, Artificial Sequence
  Synthetic
MEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLTVYVQAANLHLSLLRDAVYFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITPTLGINVVQGVGFIQPNNAEVLYRSRGTVDSLNELPIDGENSLVGYSHRLSHVTLTRSLYNTNITSLPTFVWTHHSATNTNTINPDIITQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQK

SEQ ID NO: 87 - protein, 609 aa, Artificial Sequence
  Synthetic
MPINNQKQCIPYNCLSNPEEVLLDGERILPDIDPLEVSLSLLQFLLNNFVPGGGFISGLVDKIWGALRPSEWDLFLAQIEQLINERIAEFARNAAIANLEGLGNNFNIYVEAFKEWEEDPNNPETRTRVIDRFRILDGLLERDIPSFRISGFEVPLLSVYAQAANLHLALLRDSVIFGERWGLTTKNVNDIYNRQIREIHEYSNHCVDTYNTELERLGFRSIAQWRIYNQFRRELTLTVLDIVALFPNYDSRLYPIQTFSQLTREIVTSPVSEFYYGVINSGNIIGTLTEQQIRRPHLMDFFNSMIMYTSDNRREHYWSGLEMTAYFTGFAGAQVSFPLVGTRGESAPPLTVRSVNDGIYRILSAPFYSAPFLGTIVLGSRGEKFDFALNNISPPPSTIYRHPGTVDSLVSIPPQDNSVPPHRGSSHRLSHVTMRASSPIFHWTHRSATTTNTINPNAIIQIPLVKAFNLHSGATVVRGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQK

SEQ ID NO: 88 - protein, 610 aa, Artificial Sequence
  Synthetic
MPINNQNQCIPYNCLSNPEEVFLDGERILPDIDPLEVSLSLLQFLLNNFVPGGGFISGLLDKIWGALRPSDWELFLEQIEQLINERIAEFARNAAIANLEGLGNNFNIYVEAFKEWEEDPNNPETRTRVIDRFRILDGLLERDIPSFRISGFEVPLLSVYAQAANLHLALLRDSVVFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWIHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQK

SEQ ID NO: 89 - protein, 608 aa, Artificial Sequence
  Synthetic
MPINNQNQCIPYNCLSNPEEVFLDGERILPDIDPLEVSLSLLQFLLNNFVPGGGFISGLLDKIWGALRPSDWELFLEQIEQLINERIAEFARNAAIANLEGLGNNFNIYVEAFKEWEEDPNNPETRTRVIDRFRILDGLLERDIPSFRISGFEVPLLSVYAQAANLHLALLRDSVVFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWIHRSATPRNTIDPDSITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQK

SEQ ID NO: 90 - protein, 610 aa, Artificial Sequence
  Synthetic
MPINNQNQCIPYNCLSNPEEVFLDGERILPDIDPLEVSLSLLQFLLNNFVPGGGFISGLLDKIWGALRPSDWELFLEQIEQLINQRIEEFARNQAISRLEGLSNLYQIYAESFREWEADPNNPETRTRVIDRFRILDGLLERDIPSFRISGFEVPLLSVYAQAANLHLALLRDSVVFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWIHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQK

SEQ ID NO: 91 - protein, 610 aa, Artificial Sequence
  Synthetic
MPINNQNQCIPYNCLSNPEEVFLDGERILPDIDPLEVSLSLLQFLLNNFVPGGGFISGLLDKIWGALRPSDWELFLEQIEQLIDRRIERTVRAKAIAELEGLGRSYQLYGEAFKEWEKDPNNPETRTRVIDRFRILDGLLERDIPSFRISGFEVPLLSVYAQAANLHLALLRDSVVFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWIHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQK

SEQ ID NO: 92 - protein, 610 aa, Artificial Sequence
  Synthetic
MPINNQNQCIPYNCLSNPEEVFLDGERILPDIDPLEVSLSLLQFLLNNFVPGGGFISGLLDKIWGALRPSDWELFLEQIEQLINERIAEFARNAAIANLEGLGNNFNIYVEAFKEWEEDPNNPETRTRVIDRFRILDGLLERDIPSFRISGFEVQLLSVFAQAANLHLSLLRDVVFFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWIHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQK

SEQ ID NO: 93 - protein, 610 aa, Artificial Sequence
  Synthetic
MPINNQNQCIPYNCLSNPEEVFLDGERILPDIDPLEVSLSLLQFLLNNFVPGGGFISGLLDKIWGALRPSDWELFLEQIEQLINERIAEFARNAAIANLEGLGNNFNIYVEAFKEWEEDPNNPETRTRVIDRFRILDGLLERDIPSFRISGFQVPFLSVYVQAANLHLSVLRDVSVFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWIHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQK

SEQ ID NO: 94 - protein, 610 aa, Artificial Sequence
  Synthetic
MPINNQNQCIPYNCLSNPEEVFLDGERILPDIDPLEVSLSLLQFLLNNFVPGGGFISGLLDKIWGALRPSDWELFLEQIEQLINERIAEFARNAAIANLEGLGNNFNIYVEAFKEWEEDPNNPETRTRVIDRFRILDGLLERDIPSFRISGFEVPLLLVYTQAANLHLALLRDSVVFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWIHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQK

SEQ ID NO: 95 - protein, 610 aa, Artificial Sequence
  Synthetic
MPINNQNQCIPYNCLSNPEEVFLDGERILPDIDPLEVSLSLLQFLLNNFVPGGGFISGLLDKIWGALRPSDWELFLEQIEQLINERIAEFARNAAIANLEGLGNNFNIYVEAFKEWEEDPNNPETRTRVIDRFRILDGLLERDIPSFRISGFEVPLLSVYTQAANLHLALLRDSVIFGERWGLTTTNVNDIYNRQVNRIGEYSKHCVDTYKTELERLGFRSIAQWRIYNQFRRELTLTVLDIVAVFPNYDSRLYPIRTISQLTREIYTSPVSEFYYGVINSNNIIGTLTEQQIRRPHLMDFFNSMIMYTSDNRREHYWSGLEMTATNTEGHQRSFPLAGTIGNSAPPVTVRNNGEGIYRILSEPFYSAPFLGTSVLGSRGEEFAFASNTTTSLPSTIYRNRGTVDSLVSIPPQDYSVPPHRGYSHLLSHVTMRNSSPIFHWIHRSATPRNTIDPDSITQIPAVKGAYIFNSPVITGPGHTGGDIIRFNPNTQNNIRIPFQSNAVQRYRIRMRYAAEADCILESGVNIVTGAGVTFRPIPIKATMTPGSPLTYYSFQYADLNINLTAPIRPNNFVSIRRSNQPGNLYIDRIEFIPIDPIREAEHDLERAQK

SEQ ID NO: 96 - protein, 612 aa, Artificial Sequence
  Synthetic
MPSNEHDYLKVCDDLSETNMERFDKNDALEIGMSIVSELLGMIPGGAALQFVFNQLWSRLGDSGWSAFMEHVEELIDTKIEGYAKNKALSELAGMHRNLETYIKLLNEWENNTGSSKAQGRVANYFESLEQAVERGMPQFAVGNFEIPLLTVYVQAANLHLLLLRDVSVYGKRWGWSDQKIKIYYEKQVKYTHEYTNHCSTWYNRGLDKLKNKGSSYQDWYNYNRFRREITLTVLDIVAVFPHYDVKAYPIQTVGQLTREVYTDPLINFNPQLQSVAQLPTFNVMESNAIRNPHLVDFLNNLRIFTDWFSVGRHYYWGGHRVISKRVGGREITFPIYGREAKQEPPRSFTFNGPVFRTLSNPTLRPLQQPAPAPPFNLRGLEGVKFYTPTNTFTYRGRGPRDSLTELPPGDTSVLPREGYSHRLCHATFVQRSGTPFLTTGPVFSWTHRSATDRNIIYPDVINQIPLVKAFNLTSGTSVVRGPGFTGGDIIRTNVNGSVLSMSLNFSNTTLQRYRVRVRYAASQTMVMSVTVGGSTTGNQGFPSTMSANGALTSQSFRFAEFPVGISASGSQGASISISNNVGRQMFHLDRIEFLPVTSTFEEEYDLERAQE

SEQ ID NO: 97 - protein, 612 aa, Artificial Sequence
  Synthetic
MPSNEHDYLKVCDDLSETNMERFDKNDALEIGMSIVSELLGMIPGGAALQFVFNQLWSRLGDSGWSAFMEHVEELIDTKIEGYAKNKALSELAGMHRNLETYIKLLNEWENNTGSSKAQGRVANYFESLEQAVERGMPQFAVGNFEIPLLTVYVQAANLHLLLLRDVSVYGKRWGWSDQKIKIYYEKQVKYTHEYTNHCSTWYNRGLDKLKNKGSSYQDWYNYNRFRREITLTVLDIVAVFPHYDVKAYPIQTVGQLTREVYTDPLINFNPQLQSVAQLPTFNVMESNAIRNPHLVDFLNNLRIFTDWFSVGRHYYWGGHRVISKRVGGREITFPIYGREAKQEPPRSFTFNGPVFRTLSNPTLRPLQQPAPAPPFNLRGLEGVKFYTPTNTFTYRGRGPRDSLTELPPGDTSVLPREGYSHRLCHATFIQRSGTPFLTTGVVFSWTHRSATDRNIIYPDVINQIPLVKAFNLTSGTSVVRGPGFTGGDIIRTNVNGSVLSMSLNFSNTTLQRYRVRVRYAASQTMVMSVTVGGSTTGNQGFPSTMSANGALTSQSFRFAEFPVGISASGSQGASISISNNVGRQMFHLDRIEFLPVTSTFEEEYDLERAQE

SEQ ID NO: 98 - protein, 608 aa, Artificial Sequence
  Synthetic
MPSNEHDYLKVCDDLSETNMERFDKNDALEIGMSIVSELLGMIPGGAALQFVFNQLWSRLGDSGWSAFMEHVEELIDTKIEGYAKNKALSELAGMHRNLETYIKLLNEWENNTGSSKAQGRVANYFESLEQAVERGMPQFAVGNFEIPLLTVYVQAANLHLLLLRDVSVYGKRWGWSDQKIKIYYEKQVKYTHEYTNHCSTWYNRGLDKLKNKGSSYQDWYNYNRFRREITLTVLDIVAVFPHYDVKAYPIQTVGQLTREVYTDPLINFNPQLQSVAQLPTFNVMESNAIRNPHLVDFLNNLRIFTDWFSVGRHYYWGGHRVISKRVGGREITFPIYGREAKQEPPRSFTFNGPVFRTLSNPTLRPLQQPAPAPPFNLRGLEGVKFYTPTNTFTYRGRGPRDSLTELPPGDTSVLPREGYSHRLCHATFIQRSGTPFLTTGVVFSWTHRSASPTNEVSPSRITQIPWVKAHTLASGASVIKGPGFTGGDILTRNSMGELGTLRVTFTGRLPQSYYIRFRYASVANRSGTFRYSQPPSYGISFPKTMDAGEPLTSRSFAHTTLFTPITFSRAQEEFDLYIQSGVYIDRIEFIPVTATFEAEYDLERAQK

SEQ ID NO: 99 - protein, 612 aa, Artificial Sequence
  Synthetic
MPSNEHDYLKVCDDLSETNMERFDKNDALEIGMSIVSELLGMIPGGAALQFVFNQLWSRLGDSGWSAFMEHVEELIDTKIEGYAKNKALSELAGMHRNLETYIKLLNEWENNTGSSKAQGRVANYFESLEQAVERGMPQFAVGNFEIPLLTVYVQAANLHLLLLRDVSVYGKRWGWSDQKIKIYYEKQVKYTHEYTNHCSTWYNRGLDKLKNKGSSYQDWYNYNRFRREITLTVLDIVAVFPHYDVKAYPIQTVGQLTREVYTDPLINFNPQLQSVAQLPTFNVMESNAIRNPHLVDFLNNLRIFTDWFSVGRHYYWGGHRVISKRVGGREITFPIYGREAKQEPPRSFTFNGPVFRTLSNPTLRPLQQPAPAPPFNLRGLEGVKFYTPTNTFTYRGRGPRDSLTELPPGDTSVLPREGYSHRLCHATFIQRSGTPFLTTGVVFSWTHRSADETNIIYPDKITQIPLVKSFNLNSGTSVVSGPGFTGGDIIRTNVNGSVLSMGLNFNNTSLQRYRVRVRYAASQTMVLRVTVGGSTTFDQGFPSTMSANESLTSQSFRFAEFPVGISASGSQTAGISISNNAGRQTFHFDKIEFIPITATFEAEYDLERAQE

SEQ ID NO: 100 - protein, 614 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPAVKGNFLFNGAVISGPGFTGGDLVRLNRNNDNIQNRGYIEVPIQFASTSTRYRVRVRYASTNAIEVNINWGNGSIFTGTAPATATSLDNLQSNDFGYFESTTAFAPSLGNIVGVRNFSANADVIIDRFEFIPVTATLEAEYDLERAEK

SEQ ID NO: 101 - protein, 612 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQK

SEQ ID NO: 102 - protein, 612 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSATDRNIIYPDVINQIPLVKAFNLTSGTSVVRGPGFTGGDIIRTNVNGSVLSMSLNFSNTTLQRYRVRVRYAASQTMVMSVTVGGSTTGNQGFPSTMSANGALTSQSFRFAEFPVGISASGSQGASISISNNVGRQMFHLDRIEFLPVTSTFEEEYDLERAQE

SEQ ID NO: 103 - protein, 612 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPLVKAFNLTSGTSVVRGPGFTGGDIIRTNVNGSVLSMSLNFSNTTLQRYRVRVRYAASQTMVMSVTVGGSTTGNQGFPSTMSANGALTSQSFRFAEFPVGISASGSQGASISISNNVGRQMFHLDRIEFLPVTSTFEEEYDLERAQE

SEQ ID NO: 104 - protein, 608 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPWVKAHTLASGASVIKGPGFTGGDILTRNSMGELGTLRVTFTGRLPQSYYIRFRYASVANRSGTFRYSQPPSYGISFPKTMDAGEPLTSRSFAHTTLFTPITFSRAQEEFDLYIQSGVYIDRIEFIPVTATFEAEYDLERAQK

SEQ ID NO: 105 - protein, 612 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSATTTNTINPNAIIQIPLVKAFNLHSGATVVRGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQK

SEQ ID NO: 106 - protein, 612 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPLVKAFNLHSGATVVRGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQK

SEQ ID NO: 107 - protein, 614 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSADRTNTIATNIITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 108 - protein, 614 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPAVKGNFLFNGSVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 109 - protein, 614 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPAVKGNFLFNGAVISGPGFTGGDLVRLNNSGNNIQNRGYLEVPIQFISTSTRYRVRVRYASVTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 110 - protein, 614 aa, Artificial Sequence
  Synthetic
MGRGSMEVNNQNQCVPYNCLNNPEIEILGGERISVGNTPIDISLSLTQFLLSEFVPGAGFVLGLIDLIWGFLGPSQWDAFLLQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPAVKGNFLFNGAVISGPGFTGGDLVRLNRNNDNIQNRGYIEVPIQFASTSTRYRVRVRYASTTPIQLSVNWGNSNIFSSIVPATATSLDNLQSRDFGYFESTNAFTSATGNVVGVRNFSENAGVIIDRFEFIPVTATFEAEYDLERAQE

SEQ ID NO: 111 - protein, 612 aa, Artificial Sequence; identical to SEQ ID NO: 101
  Synthetic

SEQ ID NO: 112 - protein, 609 aa, Artificial Sequence
  Synthetic
MPSNEHDYLKVCDDLSETNMERFDKNDALEIGMSIVSELLGMIPGGAALQFVFNQLWSRLGDSGWSAFMEHVEELIDTKIEGYAKNKALSELAGMHRNLETYIKLLNEWENNTGSSKAQGRVANYFESLEQAVERGMPQFAVGNFEIPLLTVYVQAANLHLLLLRDVSVYGKRWGWSDQKIKIYYEKQVKYTHEYTNHCSTWYNRGLDKLKNKGSSYQDWYNYNRFRREITLTVLDIVAVFPHYDVKAYPIQTVGQLTREVYTDPLINFNPQLQSVAQLPTFNVMESNAIRNPHLVDFLNNLRIFTDWFSVGRHYYWGGHRVISKRVGGREITFPIYGREAKQEPPRSFTFNGPVFRTLSNPTLRPLQQPAPAPPFNLRGLEGVKFYTPTNTFTYRGRGPRDSLTELPPGDTSVLPREGYSHRLCHATFIQRSGTPFLTTGVVFSWTHRSADETNIIYPDKITQIPWVKAHTLESGATVIKGPGFTGGDILTVLTSLGSLGALRVTFTGQLPQTYNIRIRYASVLNKYGTLHFSQPPAYGLTFPKTMDIDEPLTSRSFAFTTLWTPITFTRAQEEFNLTIQSGVYIDRIEFVPAEVTFEADYDLEKAQK

SEQ ID NO: 113 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 114 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattaaccaacgtatcgaagaattcgcgcgtaaccaggcaatttcacgcctggaaggtctgagtaacctttaccagatttatgctgaatcgttccgggaatgggaagcagaccctaccaacccggcacttcgtgaggaaatgcgcatccagttcaatgatatgaatagcgcgctgacaactgctatcccacttttcgccgttcagaattatcaagtgccgctgctgtctgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 115 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgatcggccagcgtatcgaagaattcgcacgcaatcaggccatttctcgtctgcaaggcctgtctaacctgtatcgcatctacaccaatgctttcaaaaattgggaagtagacccgactaatccggctctgcgcgaagaaatgcgcattcagtttaacgatatgaactccgcgctgacgactgcaattccgctgttctctgttcagggttacgaaatcccgctgctgtctgtctacgttcaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 116 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaaggattgggaagcagaccctaccaacctggaacttaaagaggaaatgcgcacccagttcaatgatatgaatagcgcgtttacaactgctatcccacttttctccgttcggggttatgaactgccgctgctgtctgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 117 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattggccaacgtatcgaagaattcgcgcgtaaccaggcaatttcacgcctggaaggtctgagtaacctttaccggatttatactaacgcgttcaagaactgggaagcagaccctaccaacccggtacttcgtgaggaaatgcgcatccagttcaatgatatgaatagcgcgtttacaactgctatcccacttttctccgttcagggttatgaaattccgctgctgggtgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 118 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattgaccaaaaaatcggagaattcgcgcgtaaccaggcaatttcacgcctggaagaaattagtagcctttacgggatttatactgaagcgttccgggaatgggaagcagaccctaccaacccggcacttaaagaggaaatgcgcacccagttcaatgatatgaatagcattctggtaactgctatcccacttttctccgttcagaattatcaagtgccgtttctgtctgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 119 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattaaccaacgtatcgaagaattcgcgcgtaaccaggcaatttcacgcctggaaggtctgagtaacctttaccagatttatgctgaagcgttccgggaatgggaagcagaccctaccaacccggcacttactgaggaaatgcgcatccagttcaatgatatgaatagcgcgctgacaactgctatcccacttttcaccgttcagaattatcaagtgccgctgctgtctgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 120 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattagccaacgtatcgaagaattcgcgcgtaaccaggcaatttcacgcctggaaggtctgagtaacctttaccagatttatgctgaagcgttccgggaatgggaagcagaccctaccaacccggcacttcgtgaggaaatgcgcatccagttcaatgatatgaatagcgcgctgacaactgctatcccacttttcaccgttcagaattatcaagtgccgctgctgtctgtttacgtccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 121 - DNA, 840 bp, Artificial Sequence
  Synthetic
gggatcgagggaaggatttcagaattaggcatggaaatcgttaataaccagaaccagtgcgttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtttctggaacagatcgaacagctgattaaccaacgtatcgcagaagccgtgcgtaacacggcaattcaagaactggaaggtatggctcgcgtttaccggacttatgctacagcgttcgcggaatgggaaaaagcccctgacgacccggaacttcgtgaggcactgcgcacccagttcactgctacggaaacctatatttcaggtcgtatctcagttttgaaaattcagacttttgaagtgcagctgctgtctgttttcgcccaggccgcgaacctgcatctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 122 - DNA, 840 bp, Artificial Sequence
  Synthetic
gggatcgagggaaggatttcagaattaggcatgccaaaagttaataacaagaaccagtgccttccgtacaactgtctgaacaaccctgaaaacgaaatcctggatatcgaacgttccaactccacggtggccaccaacatcgctctggaaatttcccgcctgctggcaagcgccactccaattggtggtattctgctgggcctgttcgacgccatttggggttctatcggcccgtctcaatgggacctgtctctggaacagattgaactgctgatcgaccagaaaatcggagagtttgctcgtaaccaggccatcagccgtctggaagaaatttcttccctgtacggtatctacacggaagcatttcgtgaatgggaagccgacccaaccaacccggcactgaaggaagaaatgcgtacgcagttcaacgacatgaactctattctggtgactgccattccgctgttttctgtgcagaactatcaagtgcctttcctgagcgtgtacgtgcaagcggccaacctgcacctgtccgtactgcgtgacgtgtctgttttcggccaggcgtggggtttcgacattgccactatcaactctcgttacaatgacctgacccgtctgatcccgatctatacggactacgctgttcgttggtacaacactggtctggatcgtctgccacgtaccggcggtctgcgcaattgggctcgtttcaaccagttccgtcgtgagctgactatctctgtgctggacatcattagcttcttccgcaactatgactctcgcctgtatccaatcccaaccagcagccagctgacgcgtgaagtgtatactgaccct

SEQ ID NO: 123 - DNA, 882 bp, Artificial Sequence
  Synthetic
gggatcgagggaaggatttcagaattaggcatggaaatcattaataaccagaaccagtgcattccgtacaactgtctgaacaaccctgaagtcgaaatcctgggtatcgaacgttccaactccacggtggtcgaagacatctctctgggactttcccgcctgctggtaagcgccattccacttggtgattttctgctgagcctgttcgacgtcatttggggtgctatcggccggtctgaatgggacatttttctggaacagattgaactgctgatcggccagcggatcgaagagtttgctcgtaaccaggccatcagccgtctggaaggcctttctaacctgtaccgtatctacacgaacgcatttaaaaactgggaagccgacccaaccaacccggtactgcgggaagaaatgcgtattcagttcaacgacatgaactctgcttttacgactgccattccgctgttttctgtgcagggctatgaaattcctttgctgggcgtggaaccgcatcggtaccaggcgaacaaaattaaatatccgctgaaaattaaaaaatatgccattctgagtgtcgagtctgctgaacgcatggcgttttttatgagcacttccgttagcgacgaacttcagcttttcgcgcaggaaattcagtcgcttctttcgagcaacattcttcgtgggttcgcccgtgatgtgggttttgtgcaacgtaccagcaaatatcaggctaaggatctggtggcgctttgtgtctggatgaaccagaatgtggcgactacctctctgacgcagctttgtagctgcttggaagcctctaccgaagtcctgatttcacccgaaggccttaaccagctgacgcgtgaagtgtatactgaccct

SEQ ID NO: 124 - DNA, 837 bp, Artificial Sequence
  Synthetic
gggatcgagggaaggatttcagaattaggcatggacaataataaccagaaccagtgcattccgtacaactgtctgagcaaccctgaacttgaaatcctggaaatcgaacgttccaacaacacggtggtcgaagacatcactctgggactttcccgcctgctggtaagcgccattccacttggtgattttattctgggcctgttcgacgtcatttggggtgctcttggccggtctgaatgggacatttttctggaacagattgaactgctgatcggccagcggatcgaagagtttgctcgtaaccaggccatcagccgtctggaaggcctttctaacctgtaccgtatctacacgaacgcatttaaagattgggaagccgacccaaccaacctggaactgaaggaagaaatgcgtacgcagttcaacgacatgaactctgcttttacgactgccattccgctgttttctgtgcggggctatgaactgcctttgctgagcgtgtacgtgcaagcggccaacctgcacctgtccgtactgcgtgacgtgtctgttttcggccagcggtggggtttcgacgttgccactgtcaaccgtcgttacgatgacctgaccactaacatcggggactatacggactacgctcttagttggtacaacactggtctgaatcgtctgccacgtaacgacggtctgcgcggttgggctcgtttcaaccggttccgtcgtgagctgactatctctgtgctggacatcattagcttcttccagaactatgactctcgcctgtatccaatcccaaccatcagccagctgacgcgtgaagtgtatactgaccct

SEQ ID NO: 125 - protein, 280 aa, Artificial Sequence
  Synthetic
GIEGRISELGMEIVNNQNQCVPYNCLNNPENEILDIERSNSTVATNIALEISRLLASATPIGGILLGLFDAIWGSIGPSQWDLFLEQIEQLINQRIEEFARNQAISRLEGLSNLYQIYAESFREWEADPTNPALREEMRIQFNDMNSALTTAIPLLAVQNYQVPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 126 - protein, 280 aa, Artificial Sequence
  Synthetic
GIEGRISELGMEIVNNQNQCVPYNCLNNPENEILDIERSNSTVATNIALEISRLLASATPIGGILLGLFDAIWGSIGPSQWDLFLEQIEQLINQRIEEFARNQAISRLEGLSNLYQIYAESFREWEADPTNPALREEMRIQFNDMNSALTTAIPLFAVQNYQVPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 127 - protein, 280 aa, Artificial Sequence
  Synthetic
GIEGRISELGMEIVNNQNQCVPYNCLNNPENEILDIERSNSTVATNIALEISRLLASATPIGGILLGLFDAIWGSIGPSQWDLFLEQIEQLIGQRIEEFARNQAISRLQGLSNLYRIYTNAFKNWEVDPTNPALREEMRIQFNDMNSALTTAIPLFSVQGYEIPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 128 - protein, 280 aa, Artificial Sequence
  Synthetic
GIEGRISELGMEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKDWEADPTNLELKEEMRTQFNDMNSAFTTAIPLFSVRGYELPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 129 - protein, 280 aa, Artificial Sequence
  Synthetic
GIEGRISELGMEIVNNQNQCVPYNCLNNPENEILDIERSNSTVATNIALEISRLLASATPIGGILLGLFDAIWGSIGPSQWDLFLEQIEQLIGQRIEEFARNQAISRLEGLSNLYRIYTNAFKNWEADPTNPVLREEMRIQFNDMNSAFTTAIPLFSVQGYEIPLLGVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 130 - protein, 280 aa, Artificial Sequence
  Synthetic
GIEGRISELGMEIVNNQNQCVPYNCLNNPENEILDIERSNSTVATNIALEISRLLASATPIGGILLGLFDAIWGSIGPSQWDLFLEQIEQLIDQKIGEFARNQAISRLEEISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 131 - protein, 280 aa, Artificial Sequence; identical to SEQ ID NO: 130
  Synthetic

SEQ ID NO: 132 - protein, 280 aa, Artificial Sequence
  Synthetic
GIEGRISELGMEIVNNQNQCVPYNCLNNPENEILDIERSNSTVATNIALEISRLLASATPIGGILLGLFDAIWGSIGPSQWDLFLEQIEQLISQRIEEFARNQAISRLEGLSNLYQIYAEAFREWEADPTNPALREEMRIQFNDMNSALTTAIPLFTVQNYQVPLLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 133 - protein, 280 aa, Artificial Sequence
  Synthetic
GIEGRISELGMEIVNNQNQCVPYNCLNNPENEILDIERSNSTVATNIALEISRLLASATPIGGILLGLFDAIWGSIGPSQWDLFLEQIEQLINQRIAEAVRNTAIQELEGMARVYRTYATAFAEWEKAPDDPELREALRTQFTATETYISGRISVLKIQTFEVQLLSVFAQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 134 - protein, 280 aa, Artificial Sequence
  Synthetic
GIEGRISELGMPKVNNKNQCLPYNCLNNPENEILDIERSNSTVATNIALEISRLLASATPIGGILLGLFDAIWGSIGPSQWDLSLEQIELLIDQKIGEFARNQAISRLEEISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDP

SEQ ID NO: 135 - protein, 294 aa, Artificial Sequence
  Synthetic
GIEGRISELGMEIINNQNQCIPYNCLNNPEVEILGIERSNSTVVEDISLGLSRLLVSAIPLGDFLLSLFDVIWGAIGRSEWDIFLEQIELLIGQRIEEFARNQAISRLEGLSNLYRIYTNAFKNWEADPTNPVLREEMRIQFNDMNSAFTTAIPLFSVQGYEIPLLGVEPHRYQANKIKYPLKIKKYAILSVESAERMAFFMSTSVSDELQLFAQEIQSLLSSNILRGFARDVGFVQRTSKYQAKDLVALCVWMNQNVATTSLTQLCSCLEASTEVLISPEGLNQLTREVYTDP

SEQ ID NO: 136 - protein, 279 aa, Artificial Sequence
  Synthetic
GIEGRISELGMDNNNQNQCIPYNCLSNPELEILEIERSNNTVVEDITLGLSRLLVSAIPLGDFILGLFDVIWGALGRSEWDIFLEQIELLIGQRIEEFARNQAISRLEGLSNLYRIYTNAFKDWEADPTNLELKEEMRTQFNDMNSAFTTAIPLFSVRGYELPLLSVYVQAANLHLSVLRDVSVFGQRWGFDVATVNRRYDDLTTNIGDYTDYALSWYNTGLNRLPRNDGLRGWARFNRFRRELTISVLDIISFFQNYDSRLYPIPTISQLTREVYTDP

SEQ ID NO: 137 - DNA, 273 bp, Bacillus thuringiensis
cagatcgaacagctgattaaccaacgtatcgaagaattcgcgcgtaaccaggcaatttcacgcctggaaggtctgagtaacctttaccagatttatgctgaatcgttccgggaatgggaagcagaccctaccaacccggcacttcgtgaggaaatgcgcatccagttcaatgatatgaatagcgcgctgacaactgctatcccacttttcgccgttcagaattatcaagtgccgctgctgtctgtttacgtccaggccgcgaacctgcatctg

SEQ ID NO: 138 - DNA, 273 bp, Bacillus thuringiensis; identical to SEQ ID NO: 137

SEQ ID NO: 139 - DNA, 273 bp, Bacillus thuringiensis
cagatcgagcaactgattaaccagcgtatcgaagaattcgcgcgtaaccaggcaatctcccgtctggaaggtctgtccaacctgtaccagatctacgcagagtccttccgtgaatgggaagctgatccgaccaacccggcactgcgcgaagaaatgcgtatccagttcaacgacatgaactctgctctgacgacggccatccctctgctggctgtgcagaattatcaggtaccgctgctgtctgtgtacgtgcaggcggctaacctgcacctg

SEQ ID NO: 140 - DNA, 273 bp, Bacillus thuringiensis; identical to SEQ ID NO: 139

SEQ ID NO: 141 - DNA, 273 bp, Bacillus thuringiensis
cagatcgaacagctgattagccaacgtatcgaagaattcgcgcgtaaccaggcaatttcacgcctggaaggtctgagtaacctttacaaagtttatgttcgggcgttcagcgattgggaaaaagaccctaccaacccggcacttcgtgaggaaatgcgcatccagttcaatgatatgaatagcgcgctgattactgctatcccacttttccgcgttcagaattatgaagtggcgctgctgtctgtttacgtccaggccgcgaacctgcatctg

SEQ ID NO: 142 - DNA, 273 bp, Bacillus thuringiensis
cagatcgaacagctgattagccaacgtatcgaagaattcgcgcgtaaccaggcaatttcacgcctggaaggtctgagtaacaactacgaaatttatactgaaacgttccgggcatgggaaaaagaccctagcaacccggcacttcgtgaggaaatgcgcacccagttcaatgttatgaatagcgcgctgattgctgctatcccacttttacgcgttcgtaattatgaagtggcgctgctgtctgtttacgtccaggccgcgaacctgcatctg

SEQ ID NO: 143 - DNA, 273 bp, Bacillus thuringiensis
cagatcgaacagctgattgaccaaaaaatcgaagaattcgcgcgtaaccaggcaatttcacgcctggaaggtattagtagcctttacggtatttatactgaagcgttccgggaatgggaagcagaccctaccaacccggcacttaaagaggaaatgcgcacccagttcaatgatatgaatagcattctggtaactgctatcccacttttcagcgttcagaattatcaagtgccgtttctgtctgtttacgtccaggccgcgaacctgcatctg

SEQ ID NO: 144 - DNA, 273 bp, Bacillus thuringiensis
cagatcgagctgctgatcggccagcgtatcgaagaattcgcacgcaatcaggccatttctcgtctgcaaggcctgtctaacctgtatcgcatctacaccaatgctttcaaaaattgggaagtagacccgactaatccggctctgcgcgaagaaatgcgcattcagtttaacgatatgaactccgcgctgacgactgcaattccgctgttctctgttcagggttacgaaatcccgctgctgtctgtctacgttcaggccgcgaacctgcacctg

SEQ ID NO: 145 - DNA, 273 bp, Bacillus thuringiensis
cagatcgaacagctgattaaccaacgtatcgccgaagccgtgcgtaacaccgcaattcaagaactggaaggtatggctcgcgtctaccgtacttatgctacagcgttcgcagaatgggaaaaagcccctgacgacccggaacttcgtgaggcccttcgcacccagttcactgctacggaaacctatattagcggtcgtatctcagttttaaaaattcagacttttgaagtgcagctgctgtctgttttcgcccaggccgcgaacctgcatctg

SEQ ID NO: 146 - DNA, 273 bp, Bacillus thuringiensis
cagatcgaacagctgattaacgaacgtatcgccgaattcgcgcgtaacgccgcaattgcaaacctggaaggtctgggtaacaacttcaatatttatgttgaagcgttcaaagaatgggaagaagaccctaacaacccggaaacccgtacgcgcgttatcgaccgtttccgtattctggatggcctgctggaacgtgatatcccatctttccgcatttctggttttgaagtgccgctgctgtctgtttacgcccaggccgcgaacctgcatctg

SEQ ID NO: 147 - DNA, 273 bp, Bacillus thuringiensis
cagatcgaacagctgattaacgaacgtatcgccgcatacgcgcgtagcgccgcaatttcaaacctggaaggtctgggtaacaacttcaatatttatgttgaagcgttcaaagaatgggaagcagaccctgacaacccggtaacccgtacgcgcgttgtcgaccgtttccgtattctggatggcctgctggaacgtgatatcccatctttccgcattgctggttttgaagtgccgctgctgtctgtttacgcccaggccgcgaacctgcatctg

SEQ ID NO: 148 - DNA, 273 bp, Bacillus thuringiensis
cagatcgaacagctgattgaccaacgtatcgaagcacacgtgcgtaaccaggcaatttcacgcctggaaggtctgggtgacagctacgaagtttatattgaatcgttacgggaatgggaagcaagccctaacaacgagagccttcagcaggacgttcgcaaccgtttcagtaatacggataacgcgctgattactgctatcccaattttacgcgaacagggttttgaaattccgctgctgactgtttacgtccaggccgcgaacctgcatctg

SEQ ID NO: 149 - DNA, 273 bp, Bacillus thuringiensis
cagatcgaacagctgattaacgaacgtatcaccacagtcgagcgtaaccgcgcaattcaaaccctgagcggtctgagtagcagctacgaagtttatattgaagcgttacgggaatgggaaaacaaccctgacaacccggcaagccaggagcgcgttcgcacccgtttccgtactacggatgacgcgctgattactgctatcccaaatttagccattcctgattttgaaattgcgacgctgtctgtttacgtccaggccgcgaacctgcatctg

SEQ ID NO: 150 - DNA, 273 bp, Bacillus thuringiensis
cagattgagcgcttgatcgaccagcgcattgaggcaacagttcgtgcgaaagcgattacggagctggagggcctgggccggaattaccagatctacgctgaagccttcaaagagtgggaaagcgacccggacaacgaagcggcaaaatcacgcgtgattgatcgtttccgcatcctggacggattgattgaagccaacattcctagtttccgtattattgggtttgaggtgccgctgctgtccgtttacgtgcaggctgcgaacctgcatttg

SEQ ID NO: 151 - DNA, 273 bp, Bacillus thuringiensis
cagattgagcagttgatcgaccagcgcattgaggcaacagttcgtgcgaaagcgattgccgagctggagggcctgggccggagttttcagctgtacgttgaagccttcaaagagtgggaagaaaccccggacaacaccgcggcacgctcacgcgtgaccgagcgtttccgcatcattgacgcacagattgaagccaacattcctagtttccgtattcctgggtttgaggtgccgctgctgtccgtttacgcgcaggctgcgaacctgcatttg

SEQ ID NO: 152 - DNA, 273 bp, Bacillus thuringiensis
cagattgagcagttgatcgaccgtcgcattgaggcaacagttcgtgcgaaagcgattgccgagctggagggcctgggccggagttaccagctgtacggtgaagccttcaaagagtgggaaaaaaccccggacaacaccgcggcacgctcacgcgtgaccgagcgtttccgcatcattgacgcacagattgaagccaacattcctagtttccgtgtatccgggtttgaggtgccgctgctgtccgtttacacgcaggctgcgaacctgcatttg

SEQ ID NO: 153 - DNA, 273 bp, Bacillus thuringiensis
cagattgagcagttgatcgaccgtcgcattgagcgtacagttcgtgcgaaagcgattgccgagctggagggcctgggccggagttaccagctgtacggtgaagccttcaaagagtgggaaaaaaccccggacaacaccgcggcacgctcacgcgtgaccgagcgtttccgcatcattgacgcacagattgaagccaacattcctagtttccgtgtatccgggtttgaggtgccgctgctgctggtttacacgcaggctgcgaacctgcatttg

SEQ ID NO: 154 - DNA, 273 bp, Bacillus thuringiensis
cagatcgaacagctgattaaccaacgtatcaccgaattcgcgcgtggccaggcaattcaacgcctggtaggttttggtcgcagctacgatgaatatattttagcgttaaaagaatgggaaaacgaccctgacaacccggcaagcaaagagcgcgttcgcacccgtttccgtactacggatgacgcgctgttaactggtgtcccacttatggccattcctggttttgaactggcgacgctgtctgtttacgcccagtccgcgaacctgcatctg

SEQ ID NO: 155 - DNA, 273 bp, Bacillus thuringiensis
cagattgaacagctgatccgtcaggaaatcaccgagctggaacgtaaccgtgccactgcaatcctgaccggcctgtcttcctcctacaacctgtacgtagaagcactgcgtgaatgggaaaatgacccaaataacccggcatctcaagaacgcgttcgtacgcgtttccgtctgaccgacgatgcgatcgtgactggtctgccgactctggctattcgtaacctggaggtggtgaacctgagcgtgtacacgcaagcggccaacctgcacctg

SEQ ID NO: 156 - DNA, 273 bp, Bacillus thuringiensis
cagatcgaacagctgatcgaccaacgtatcgagactgtggaacgcaaccgtgcgattcaaaccctgatcggtctgagcaattcttatgatgtcaacatcgaagcgctgaaggaatgggaaaacaacccggataacagcgcgtcccaggaacgtgttcgtaaccgcttccgcactacggacgatgccctgatcacttctattccgctgctggcgatcccgaacttcgagattgcgactctgtccgtgtatgttcaggcagcgaacctgcatctg

SEQ ID NO: 157 - DNA, 276 bp, Bacillus thuringiensis
catgttgaacagatcgttcgtcagcagcagatcacggacagcgtacgtgacactgcaattgcacgtctggaaggtctgggtcgcggctatcgttcttatcagcaggcgctggaaacctggctggacaaccgtaacgacgcacgcagccgttccatcattcgcgaacgttatatcgccctggaactggacattactacggctatcccactgttctccattcgcaacgaggaagtgccgctgctgatggtttacgcccaggccgcgaacctgcatctg

SEQ ID NO: 158 - DNA, 273 bp, Bacillus thuringiensis
cacgtggaagaactggtagctcagaagatctccacctatgcacgcaacaaagcgctgagcgatctgaaaggcctgggcgatgctctggcagtctaccacgaatctctggaaagctggatcgaaaaccgtaacaacacccgtgctcgttctgtcgtgaaaaaccaatacatcgcgctggaactgatgttcgttcagaatctgccgtctttcgcagtctccggcgaggaagttccgctgctgccgatctatcgtcaggctgctaacctgcacctg

SEQ ID NO: 159 - protein, 91 aa, Bacillus thuringiensis
QIEQLINQRIEEFARNQAISRLEGLSNLYQIYAESFREWEADPTNPALREEMRIQFNDMNSALTTAIPLFAVQNYQVPLLSVYVQAANLHL

SEQ ID NO: 160 - protein, 91 aa, Bacillus thuringiensis; identical to SEQ ID NO: 159

SEQ ID NO: 161 - protein, 91 aa, Bacillus thuringiensis
QIEQLINQRIEEFARNQAISRLEGLSNLYQIYAESFREWEADPTNPALREEMRIQFNDMNSALTTAIPLLAVQNYQVPLLSVYVQAANLHL

SEQ ID NO: 162 - protein, 91 aa, Bacillus thuringiensis; identical to SEQ ID NO: 161

SEQ ID NO: 163 - protein, 91 aa, Bacillus thuringiensis
QIEQLISQRIEEFARNQAISRLEGLSNLYKVYVRAFSDWEKDPTNPALREEMRIQFNDMNSALITAIPLFRVQNYEVALLSVYVQAANLHL

SEQ ID NO: 164 - protein, 91 aa, Bacillus thuringiensis
QIEQLISQRIEEFARNQAISRLEGLSNNYEIYTETFRAWEKDPSNPALREEMRTQFNVMNSALIAAIPLLRVRNYEVALLSVYVQAANLHL

SEQ ID NO: 165 - protein, 91 aa, Bacillus thuringiensis
QIEQLIDQKIEEFARNQAISRLEGISSLYGIYTEAFREWEADPTNPALKEEMRTQFNDMNSILVTAIPLFSVQNYQVPFLSVYVQAANLHL

SEQ ID NO: 166 - protein, 91 aa, Bacillus thuringiensis
QIELLIGQRIEEFARNQAISRLQGLSNLYRIYTNAFKNWEVDPTNPALREEMRIQFNDMNSALTTAIPLFSVQGYEIPLLSVYVQAANLHL

SEQ ID NO: 167 - protein, 91 aa, Bacillus thuringiensis
QIEQLINQRIAEAVRNTAIQELEGMARVYRTYATAFAEWEKAPDDPELREALRTQFTATETYISGRISVLKIQTFEVQLLSVFAQAANLHL

SEQ ID NO: 168 - protein, 91 aa, Bacillus thuringiensis
QIEQLINERIAEFARNAAIANLEGLGNNFNIYVEAFKEWEEDPNNPETRTRVIDRFRILDGLLERDIPSFRISGFEVPLLSVYAQAANLHL

SEQ ID NO: 169 - protein, 91 aa, Bacillus thuringiensis
QIEQLINERIAAYARSAAISNLEGLGNNFNIYVEAFKEWEADPDNPVTRTRVVDRFRILDGLLERDIPSFRIAGFEVPLLSVYAQAANLHL

SEQ ID NO: 170 - protein, 91 aa, Bacillus thuringiensis
QIEQLIDQRIEAHVRNQAISRLEGLGDSYEVYIESLREWEASPNNESLQQDVRNRFSNTDNALITAIPILREQGFEIPLLTVYVQAANLHL

SEQ ID NO: 171 - protein, 91 aa, Bacillus thuringiensis
QIEQLINERITTVERNRAIQTLSGLSSSYEVYIEALREWENNPDNPASQERVRTRFRTTDDALITAIPNLAIPDFEIATLSVYVQAANLHL

SEQ ID NO: 172 - protein, 91 aa, Bacillus thuringiensis
QIERLIDQRIEATVRAKAITELEGLGRNYQIYAEAFKEWESDPDNEAAKSRVIDRFRILDGLIEANIPSFRIIGFEVPLLSVYVQAANLHL

SEQ ID NO: 173 - protein, 91 aa, Bacillus thuringiensis
QIEQLIDQRIEATVRAKAIAELEGLGRSFQLYVEAFKEWEETPDNTAARSRVTERFRIIDAQIEANIPSFRIPGFEVPLLSVYAQAANLHL

SEQ ID NO: 174 - protein, 91 aa, Bacillus thuringiensis
QIEQLIDRRIEATVRAKAIAELEGLGRSYQLYGEAFKEWEKTPDNTAARSRVTERFRIIDAQIEANIPSFRVSGFEVPLLSVYTQAANLHL

SEQ ID NO: 175 - protein, 91 aa, Bacillus thuringiensis
QIEQLIDRRIERTVRAKAIAELEGLGRSYQLYGEAFKEWEKTPDNTAARSRVTERFRIIDAQIEANIPSFRVSGFEVPLLLVYTQAANLHL

SEQ ID NO: 176 - protein, 91 aa, Bacillus thuringiensis
QIEQLINQRITEFARGQAIQRLVGFGRSYDEYILALKEWENDPDNPASKERVRTRFRTTDDALLTGVPLMAIPGFELATLSVYAQSANLHL

SEQ ID NO: 177 - protein, 91 aa, Bacillus thuringiensis
QIEQLIRQEITELERNRATAILTGLSSSYNLYVEALREWENDPNNPASQERVRTRFRLTDDAIVTGLPTLAIRNLEVVNLSVYTQAANLHL

SEQ ID NO: 178 - protein, 91 aa, Bacillus thuringiensis
QIEQLIDQRIETVERNRAIQTLIGLSNSYDVNIEALKEWENNPDNSASQERVRNRFRTTDDALITSIPLLAIPNFEIATLSVYVQAANLHL

SEQ ID NO: 179 - protein, 92 aa, Bacillus thuringiensis
HVEQIVRQQQITDSVRDTAIARLEGLGRGYRSYQQALETWLDNRNDARSRSIIRERYIALELDITTAIPLFSIRNEEVPLLMVYAQAANLHL

SEQ ID NO: 180 - protein, 91 aa, Bacillus thuringiensis
HVEELVAQKISTYARNKALSDLKGLGDALAVYHESLESWIENRNNTRARSVVKNQYIALELMFVQNLPSFAVSGEEVPLLPIYRQAANLHL

SEQ ID NO: 181 - DNA, 1845 bp, Bacillus thuringiensis
atgggccgcggtagcatggaagtcaacaatcaaaatcaatgcgtgccgtacaattgcctgaacaacccggaaattgaaattttaggcggtgaacggatctcagtggggaacacgccaattgatatcagtctgtccttgacgcaatttctgttgtcggaattcgtacctggtgccggctttgtattggggcttattgacttgatctgggggtttctggggcctagccagtgggacgcatttctgctgcagatcgaacagctgatttcacagcgtattgaggagtttgctcgcaaccaagcgattagccgcttggaaggattgtcaaacctgtatcgcatttacgcggaagccttccgcgcatgggaagccgatcccacaaacctggctttgcgcgaagaaatgcgcacacaattcaacgatatgaactctgccctggtgacagccattccgttgttctcagtgcagaattatcaggtgccacttctgagcgtgtatgtgcaagcggcgaacctgcatctgtccgtgttgcgcgacgttagcgtgttcggtcagcgttggggatttgatgttgccacgattaatagccgttacaacgatctgacacggttgattggcgagtacacggactacgccgtgcgttggtataacacagggcttgaccgccttcgcggttcgaacttccaggattggattcgttataatcgttttcgccgcgagctgacgttgaccgtgttggacatcgtgtcggtctttcagaattatgacagtcgcctttatccgatccagacgagctctcaattgacgcgtgaaatttattccgatcttctgctggccaaccccagtggtgtgggtagtttctctaatgtagatttcgatagcattctgatccgtcagcctcatctgatcgatttcatgcgcgttttaacgatttacacggatcgccataatgcttcccggcacaacatctattgggcgggccatcaagtaaccgcagtagatacagccaaccgtacgattgtgtaccctgtcaatggcagtgcagccaacttggaacctccgcggacgttgcggtttgagtcccccgtcgtggaaattcgctctaatccggtgtgggaccgcggaagtactggcatcgcaggctcgtatgaattctttggtgtgaccagtgctttgttcattacaatcctgggttttggctatacctatcgctcagggagcaacaccgaagtgacggcacttccggatcatcaggtcagccacattggttacttccgtcgctttaccaccaccggggcgaccgctcgtcagaccttgacaagcgcacctattgtgtcgtggactcattcgagcgctgaaccgccaaaccgtatctatcaaaaccgtattacccagatcccagccgttaaaggtaacttcctgtttaacggagctgtcatctcagggcctggatttaccggtggcgatcttgtccgccttaaccgcaacaatgataatattcaaaatcgcggttatattgaagttccgatccagttcgcctcgactagcacgcgttatcgcgtacgcgtccgttacgccagcactaatgcgattgaggtgaatattaactggggtaatggcagtattttcaccggaaccgccccagcaaccgcgacgagcctggataacctgcagagcaatgattttggttacttcgagagcaccacggcctttgccccttcgctggggaacattgtaggcgtgcgtaacttctctgctaatgccgatgtgatcattgatcgctttgagtttatccccgtaacggcaaccctggaagcggagtatgatctggaacgcgcggaaaaataa

SEQ ID NO: 182 - DNA, 2040 bp, Bacillus thuringiensis
atgccccgaaataatcaaaatgattatgaagttattgacgcttccaattgtggttgtgcgtcaggtgatgttgtgaaatatcctttgacaaatgatccgaatgccggattacaaaatatcaattataaagagtacttacaaatgtcagatgagaactacactgattcctatataaatcctagtttgtctattagtgggaaatctgtaatacaagttggaattaacattgtagggaggttgttgagcttttttggattcccatttgctaatcaagtggtcgctgtctatagctaccttttaaacaccttatggccaaataatgatactgaagtatgggaatcttttatggcacaagtagaagaacttgttgatcaaaaaatatcagaagcggtagtagggaccgcattggatcatttatctggattaaactataattatgaattatatgtagaggctttggaagagtggctggaaagaccaaatgccgcaagagccaacctagtttttaatagatttactacactagatagtctatttacgcaatttatgccaagttttggctctggtcctgggagtaataggtatgcagattcattactttcagtatatgcacaagcagcaaaccttcatttgttattcttaaaagatgcagacatttatggagctagatgggggctgaatcaaactcaaatagatcaataccataatcgtcaacaaacccttactcggaattatacaaatcattgtgttactacgtttaatgatggattagagaaaataagaaacacaagcgctgagagttggtttaaatacaatcaatatcgtagagagatgacattaatggcaatggatttagtggcattatttccgtattataatgtacgagaatactcaatggcagtaaatcctcaacttacacgagaggtgtatacagatccaattgcatttgatccatcagaacaaccgaatactcaattgtgtcgaaaatggtatactgcccgctttgtacagaataacgttaatttttctcagttagaaaatgcattcattcgttcaccacatctcttcgaaagattacattctctggaaattaattttataaatggagctaattggtggtggcataaggtaaggaaccaacttttaaataattcattaatactcgaaagagattacggtacatctactgttaattctcctacgactcaacttaccgtgaatacttcaaatgctgatatataccaagtacgttctcgtgcagaaaatccgactgcagctgcaggtacttactattcagttagaggtgttgagttttatttaagctcaggcgttaagagggagttttctggaactacagtcgctcctttggcttgccaagaattgcgaaattcaattgatgagttaccaagtttagaaccaaatgagcctatcatcagaaattatagtcatagattatctcatattacttggtaccaatttagtggccgccaaagtggaaatccgactactaataatggggatatacctacttatgtctggacacatcgcgatgtggactttaataatacaattactcccaatagaattactcaaataccatggataaaggcatctgaaatagctgcgaatactactgtcgtaaaaggcccaggatttacaggaggggatatacttcgaagcacgatccctggtacagttggaacgattagggctaatgttatggccccattaacacaacaatatcgtataagattacgttatgcgtcgacaacaaattttgttgttaatttatttgttaacaattcagctagtggttttactctcccaagtacaatggttcaaaatgagtctttaacatacgaatcgtttaataccgaagaggtgacaagaactattagattttcacagtcagacactacactgagattgggtatattttcgtttgaccctggtcaagaagtgtatgtagataaacttgaaatcgttccaattaatccagctcgtgaggcggaagaggatttagaagcagcgaaaaaataa

SEQ ID NO: 183 - DNA, 1845 bp, Bacillus thuringiensis
atgccgaataatattcaaaatcaatgcgtaccttataattgtctaagcacccctgagaaaatactattagatgaggaaagaattgagactgggaatacatcaatcgatctttctttgtcgcttgtgagccttcttttaggtgaattcgtccctggtgcgtcatttgtactaggtctaattgatataatatggggatttgcaggtccctctcaatgggacgcatttctggtacagattgaacagttaattgacgaaagaataggtcagttcgcaaggaatcaagcaatttctagattagaagggctaagcaatctctatcaaatatacgcagaagattttacacagtgggaagcagatcccgataatccagcattaagagaagagatgcgtactcaattcaatgatatgaacagtgctcttacaaccgctattcctcttttggcagttcaaaactatcaaattcctcttttatcagtatatgttcaagctgcaaatttacatttatcagttttgagagatgtttcagtgtttggacaaagttggggatttgatgcggcgactattaatagccgttataatgatttaactaggcttattagcagctatacagatcatgtagtaagatggtatgatacaggattagaccgtttgcgaggctctacttaccaagactggtttagatacaaccgatttagaagagaattaacattgactgcattagatatcgttgctcttttcccaaactatgatatcaaaatgtatccaatccaacccgttagccaactaacaagggaagtttatacggacccattaattaatttcaatccgcagttacagtctgtagctcaattgcctacttttaacgttatggaaagtaacgcaattagaaaccctcatttagttgacttcttgaataaccttagaatttttacagattggtttagtgtcggacggcactattattggggaggacatcgagtgatttccaaacgtgtaggaggaagggagataaccttccctatatatggaagggaggcaaagcaggaacctccaagatcctttacttttaatggacctgtttttaggacgttatcaaatcctaccctaagaccattacaacaacctgcaccagctcctccttttaatttacgtggcttggaaggtgtaaaattttatacacctacaaatacctttacgtatcggggaagaggcccgcgtgattctttaactgaattaccgcctggagatacaagtgtactacctcgcgaaggatatagtcaccggttatgtcatgcaacatttattcaaagatctggcacaccttttttaacaacaggcgtagtcttttcttggacacatcgtagtgctgatgaaacgaatataatttatccagataagattactcaaattccatgggtaaaggcgcatacccttgaatcgggggccactgttattaagggtcctggatttacaggaggggatattcttactgttcttactagtcttggttccttgggcgctttacgagtaacttttacggggcaattaccacaaacatataatatacgaatccgatatgcctcggtgctaaataaatatggtacactccatttttcacagccacctgcatatgggctcacatttccaaaaactatggatatagatgaaccattaacatctcgctcgtttgcttttacaactctttggacaccaataacctttacacgagcacaagaggaatttaatctaacaatacaatcaggtgtttatatagatagaattgaatttgttccggcagaagtaacatttgaggcagactatgacttggaaaaagcgcaaaagtaa

SEQ ID NO: 184 - DNA, 1854 bp, Bacillus thuringiensis
atggataataataatcaaaatcaatgcataccttacaattgtttaagtaatcctgaattagagatattagagattgaaagatcaaataataccgtagtagaagacatcaccttggggctgagtcgtctgctcgtttccgcaattccactaggggattttatacttggcttgtttgatgtaatatggggggctttaggtcgttcagagtgggatatatttttagagcaaattgagctattgatcggccaaagaatagaggaatttgctaggaatcaggcaatttctagattagaagggctaagcaatctttatcgaatttacacaaatgcttttaaagactgggaagcagatcctactaatctagaattaaaagaagagatgcgtactcaatttaatgacatgaacagtgcttttacaacagctattcctcttttttcagttcgaggttatgaacttcctcttttatcagtatatgttcaagctgcaaatttacatttatcagttttaagagatgtttcagtgtttggacaacgttggggatttgacgtagcaacagtcaatcgtcgttatgatgatttaactacgaatataggcgactacacagattatgctttaagctggtataatacgggattaaaccgtttaccacgtaatgatgggctgcgaggatgggcaagatttaataggtttagaagagagttaacaatatcagtattagatattatttcttttttccaaaattacgattctagattatatccaattccaacaatctcccaattaacgcgggaagtatatacagatccggtaattaatataactgattatagagttaccccaagtttcgagagtattgaaaactcagccattagaagcccccatcttatggatttcttaactaatataattattgacactgatttaataagaggtgtttactattgggcaggacatcgtataaattctcgctttaccgggaccgcttttccacatataataacatctcctcaatatggaataactgcaaacgcagaaccaagacgtacaatagtgcctggtccttttcaaggtgtgccttccctactttatagaacactatcagaccctttcttccgaagatcagacaatattagtccaaccttagggataaatgtagtacagggggtagggttcttacaaccaaataattttgaatctctatatagaaggagagggacagtagattctctcgatgagttgccaattgatggtgaaaatccattagttggatatagtcatcgattaagtcacgttacattaaccaggtcattatttaatactaatataactagcctgccaacatttgtttggacacatcacagtgctactgatacaaatacaattgctccagatgtcattacccaaataccgttagtaaaggcttttaatcttcattcaggtgccacggttgctagagggccaggatttacaggtggggatatccttcgaagaacgaatgttggtaactttggagatatgcgtgtaaatattactgcaccactatcacaaagatatcgagtaaggattcgttatgcttctactacaaatttacgattccatacatcaattaacggaagagctattaatcaggcggattttccagctactatgaatagtgggggtaatttacagtccggaagcttcaggattgcaggttttactactccatttaccttttcagatgcactaagcacattcacaataggtgcttttggcttctcttcaggtaacgaagtttatatagatcgaattgaatttgttccggcagaagtaacctttgaggcagaatatgatctagaaagagcacaaaagtaa

SEQ ID NO: 185 - DNA, 2004 bp, Bacillus thuringiensis
atggagataataaataatcagaatcaatgcattccttacaattgtttaaataatcctgaagtagagatattagggattgaaaggtcaaatagtaccgtagtagaagacatcagcttggggcttagccgtctgttagtttccgcaatcccacttggggattttttacttagcttgtttgatgtaatatggggggctataggtcgttcagaatgggatatatttttagagcagattgagctattgatcggccaaagaatagaggaattcgctaggaaccaggcaatttctagattagaagggctaagcaatctttaccgaatttacacaaatgcttttaaaaactgggaagcagatcctactaatccagtattaagagaagagatgcgtattcaatttaatgacatgaacagtgcttttacaacagctattcctcttttttcagttcaaggttatgaaattcctcttttaggggtagaaccacatcgctatcaagctaacaaaataaaataccccctaaaaataaaaaaatacgctattctttctgtagaatcagcggaaaggatggcgttttttatgtctacttctgtatctgatgaattacaactcttcgctcaggaaattcagagcttattatcttcaaatatcttaagaggttttgctagagatgttggttttgtacagcgaaccagtaagtaccaagccaaagatttagtcgctttatgtgtatggatgaaccaaaatgtcgctacgacgtctttaactcagttatgtagctgtttagaagcatcaacagaagtactcatcagccctgaaggactaaatcaacgatttaataaagcagccgtccaatttttacaacacatactagctgaactactaaaccaaaaattagcctcatctatgccgatttcttctccatatacttctattttcaagcgtattcgtattttagattcaactgcatttcaactcccggatgtattttcatcggtttatccaggtgcaggaggatgtagccatacagctgggataaaaattcaacttgagtatgatttgttaagtggacagtttttacatattcatacaggtccaggtaaacaacatgatcgtacttacggcactctgtgtgccccaactgtgacagcgaatgatttatgtatccgagatttaggttattttcatttaaaagaccttcaatatatacaagataaagaggcctactatatctctcgtatcaagtcgaatacacgtatttatcaaaaaaatcctaaccctgattattttcaagatggaagaattaaaaaagggacagagtatatacagatagatatggagacgttaatgaactcccttcaaccaggacaaacatatgaaatagctgatgcttatgtaggaatgattgataaagtgccagctcgtgtaattgttcatcgattaacaaaacaacagcaacaaaaacgattacaagatcaagctgtaagagaaaaaaagaaaggaatgaagtattctcctcgtagtaaacgactcagtggtatcaatgtatatatgacaaacacccctacagatattgtcccgatgggacaggtacatgactggtattctttgcgttggcaaatcgaaattttatttaaaacgtggaagtcattctttcacattcatcattgtaaaaagataaaaccagaacgattggagtgccatttatatggtcaattgattgccattctactctgttcttctatcatgtttcaaatgcgccaattgctcctcataaagaaaaaacgagagcttagtgagtataaagccatatatatgattaaagactattttcttcttctattccaaactatacaaaaaaacacccaagagctatcaaaggtgttacttcgcctgttcaatctcctgcagcaaaacgggcggaaatctcatcgatatgagaaaaaaacagtctttgatatattaggtgtcgtttacaattgtaccatgtcagataatcaagcggcttaa

SEQ ID NO: 186 - DNA, 2082 bp, Bacillus thuringiensis
atgcctcgaaataatcaaaatgaatatgaagttattgatgcttccacttgcgggtgcccgtcagatgatgttgtaaaatatcctttgacagatgatccgaatgctggattgcaaaatatgaactataaggaatatttacaaatgtatggtggagactatacagatcctcttatcaaccctaacttacctgttagtggaaaagatgtaatacaagttggaattaatattgtagggagattacttagcttttttggattccccttttctagtcaatgggttgctgtatatacccatcttttaaacagcttgtggccggatgatgagaattctgtatgggatgcttttatgaagagagtagaagaacttattgatcaaaaaatcgcagaagcagtacatggtctggcattggatcacctaactggattacaacataattataatttatatgtagaagcattagatgagtggctgaatagaccgaatggggcaagggcagccttagtttctcagcgatttaacaatttagatagcctatttacacaatttatgcctagctttggctctggtcctggaagtcgaaattatgcaactatattacttccagtatatgcacaagcagcaaaccttcatttgttattattaaaagatgtagacatttatggagctagatgggggctgaatcaaactcaaatagatctattccattctcgtcaacaagggcttactcagacttatacaaatcattgtgttactgcgtataatgatggattagcggaattaagaggcacaagcgttgagagttggctcaaatatcatcaataccgtagggaaatgacagtaacggcaatggatttagtggcattattcccatactataatgttcgacaatatccaaatggggcaaatccacaacttacacgtgaggtatatacagatccaatcgtatttaatccgcctaagcctccaagtggcgctttctgcgaaagtttttatactatccgagcggcacgagaacgtttaactttttcgcaacttgaaaatgcaataattcgtccaccgcgcttgtttgaaaggtttcaagcattagggatttatacacacgaggcgagactgaatcaaaatagtgctccaatgaactattggattggacattttataagaaatactcgtttgggtgactcaacaacaattacttcaaattatggaacaaccaataatcgtttaactaatttcactcctcctactaacagtgatgtttatcaaattaattcaatctcaagtaatttagccgctattttaggcactatatttggggttactaacgcagcattccatcatggatcaggaaatatttggtcgtatgtcggacaaaataacgttcttgcacaatgtcatcaaaactataattcaatagaagaattaccaaaccaaagcgatgaacctacagttagaagttatagccatagattatctcatatcacctcttttaatttcaatgtacagcttaataatcctgtactctctactggcaatatgcctgtatatgtgtggacacatcgcggtgtggaccttaataacacgattacttcagatagaattactcaattaccattggtaaaggcatctgaacttgttgcaggtactactgtcgtgaaaggaccaggattcacaggaggagatatacttcgaagaacgagcaatggtaattttggaacaataagagtaatggttagttcaccattaacacaacaatatcgcctaagagttcgttatgcctcaacaggaaatttcagcatagtggtaagacgtggaagcactactgtaggtaatattagagtcccaagtacaatgaacaggggagcggaattcaggtacgaatcctttgacacgagagagtttactactactggtccgcagaatccgccttttacatttacacaaactcaagagagtctaacagtggctgcagaaggtgttagcaccggtagtgaatattttatagatcgaattgaaatcatccctgtaaatccgacacgagaagcggaagaggatttagaagcagcgaagaaagcggtggcgtaa

SEQ ID NO: 187 - DNA, 2082 bp, Bacillus thuringiensis; identical to SEQ ID NO: 186

SEQ ID NO: 188 - DNA, 2124 bp, Bacillus thuringiensis
atgaatcgaaataatcaaaatgaatatgaagttattgatgccccccattgtgggtgtccgtcagaggatgttgtaaaatatcctttgacagatgattcgaatgctggattgcaaaatatgaattataaagagtatttgaatatgtctgagggagattatgctgattcaattagatatcctttagccaataatccatattcatctgctttaaatttaaattcttgtcaaaatagtagtattctcaactggattaacatattaggaaatgcagcaaaagaagccatatctattgggacaacaataatctctattattacaacaccttctctcactggattaatttcaataacttatgatcttataagtaaagtgctaggaggtagtagtggcccatccatatcagatttgtctatatgtgacttattatctattattgatttacggataagtcaaagtgttttgaatgatgggattgctgattttaacggttctataatcatatataggaactatttggaagcattagatagctggaataagaataatactcctgctgctgctgaagaggtccgtgctcgttttagagccgctgacacagaatttgatagaattttaacacgagggtctttaacaaatggtggctcgttagctagacaagatggccaaatattattattaccttcttttgcaagtgctgcatatttccatttatcactattgagagatgctgctaggtatggggctaattgggggctattcaatgctacacctcttataaattatcagtcaaaattagtagaacttattgaatcatatactaattattgtgtacattggtataatcaaggtcttaaccaactaaggcaacgaggtaatagtgctacagcttggttagaatttcatagatatcgtagagagatgacattgatggtattagatatagtagcatcattttcaagtcttgatattactagatatccgatagaaacagattttcagttgagtagggtcatttatacagatccaatcggttttgtaaatcgtggtaatcttaggctggaaagctggttcagctctgttaataacgctactttttcagggctagaaagtgcaatacctaatcctagccagtcttggtttttaaatagtatgattatatctactggttcacttacattgccagttagcccaaatactgatagagcgagggtgtggtatggggggcgagatcgagtttctcctgctagttcacaatttattactgaacaaatgtctgggcaacagacggctgatacccaaaatattttagggcgaaatatatttagaatagattctcaagcatgtaatttaaataataccacttatggagttaatagggctttattttatcatgatgctagtcagggttctcaaagatctttatatgaaggttttattagaacaacagggatagataatcctgttgttcagaatattaacacttatttccctggagaaaattcagatatcccaactccacaagactatactcatatattaagtagaacaataaatttaacagggggacttagacaagtagcatctggtcgtcgttcttctctagtaatgtatggttggacacataagagcctgactcttaacaataccattaatccagatagaattacacagataccgttgacaaagctagatagccggggttcaaatatttcttatgtgaacgatccaggatttataggcggaaatctactcagaatgacggccaatggtacacttggaacattaagggcaaatttcccacttaacattagatcacattttcgcattagagtccgttatgctgctacaagaaatattcgattgagtgtaaatggaagtttcggtactatttctcaggaatttcctagtacaatgagattgggagaggatttaagatacggttcctttgctataagagagtttagtacatctgttagacccactgcaagtcctgacgtaatccgattgacagtagagccaattttctctgggcaacagatttatgtagacagaattgagttcgtcccagttattcccacaagagaagcggaagagaatttagacgcagcgaagaaagcggtggcg

SEQ ID NO: 189 - DNA, 1971 bp, Bacillus thuringiensis
atgccatctaagaatcaaaatatgtatcaaagtttgtctagcaatacgacagttgataaaaactttacaaattcactagaaaacaacacaaatatggaattacaaaatattaattatgaagattgtttgagaatgtctgagtatgaaggtatagagccgtttgttagtgtatcaacaattcaaacaggtattggtattgcgggtaaaatacttggtaccctaggcgttccttttgcaggacaagtagctagtctttatagttttatcttaggtgagctatggcctaaggggaaaagccaatgggaaatctttatggaacatgtagaagagattattaatcaaaaaatatcaacttatgcaagaagtaaagcacttacagacttgaaaggattaggagatgccttagctgtctaccatgaatcgctggaaagttgggttggaaatcgtaataacacaagggctaggagtgttgtcaagagccaatatatcgcattagaattgatgttcgttcagaaactaccttcttttgcagtgtctggagaggaggtaacattattaccgatatatgcccaagctgcaaatttacatttgttgctattacgagatgcgtctatttttggaaaagagtggggattatcatcttcagaaatttcaacattttataaccgtcaagtcgaacgagcaggagattattccgaccattgtgtgaaatggtatagcacaggtctaaataacttgaggggtacaaatgccgaaagttgggtacgatataatcaattccgtagagacatgactttaatggtactagatttagtggcactatttccaagctatgatacacaaatgtatccaattaaaactacagcccaacttacaagagaagtatatacagacgcaattgggacaatacatccgcatccaagttttacaagtacgacttggtataataataatgcaccttcgctctctgccatagaggctgcggttatccgaagcccgcatctacttgattttccagaacaacttacaatttacagcacattaagtcgatggagtaacactcagtatatgaatatatgggtaggtcatagacttgaatctcgaacaataggagggtcattaaatacctcgacacaaggatctaccaatacttctattaatcctgtaagattacagtttacggctcgagacgtttataggactgaatcattggcagggctaaatatatttttaactcaacctgttaatggggtaccttgggttagatttaattggagaaatcccctgaattctcttagaggtagccttctctatactatagggtatactggagttgggacgcaattacaagattcagaaactgaattaccaccagaaacaacagaacgaccaaattatgaatcttacagtcatagattatctcatataggactcatttcatcatctcatgtgagagcattggtatattcttggacgcaccgtagtgcagatcgtacaaatacaattggaccaaatagaattacacaaataccattggtaaaagcacttaaccttcattcaggtgctactgttgttagagggccaggatttacaggtggggatatccttcgtagaacgaatactggtacatttggagatatacgtttaaatattaatgtgccattatcccaaagatatcgcgtaaggattcgttatgcttctactacagatttacaatttttcacgagaattaatggaaccactgttaatattgctaatttctcaagaactatgaataggggggataatttagaatctagaagttttagaactgcaggatttagtactccttttaatttttcaaatgcccaaagcacattcacattgggtgctcagagtttttcaaatcaggaagtttatatagatagaattgaatttgttccggtagaagtaacatatgaggcagaatatgattttgaaaaagcgcaagag

SEQ ID NO: 190 - DNA, 1986 bp, Bacillus thuringiensis
atgccactaaagaatcaagataagcatcaaagtttttctagcaatgcgaaagtagataaaatctctacggattcactaaaaaatgaaacagatatagaattacaaaacattaatcatgaagattgtttgaaaatgtctgagtatgaaaatgtagagccgtttgttagtgcatcaacaattcaaacaggtattggtattgcgggtaaaatacttggtaccctaggcgttccttttgcaggacaagtagctagtctttatagttttatcttaggtgagctatggcctaaggggaaaaatcaatgggaaatctttatggaacatgtagaagagattattaatcaaaaaatatcaacttatgcaagaaataaagcacttacagacttgaaaggattaggagatgccttagctgtctaccatgattcgcttgaaagttgggttggaaatcgtaataacacaagggctaggagtgttgtcaagagccaatatatcgcattagaattgatgttcgttcagaaactaccttcttttgcagtgtctggagaggaggtaccattattaccgatatatgcccaagctgcaaatttacatttgttgctattaagagatgcatctatttttggaaaagagtggggattatcatcttcagaaatttcaacattttataaccgtcaagtcgaacgagcaggagattattccgaccattgtgtgaaatggtatagcacaggtctaaataacttgaggggtacaaatgccgaaagttgggtacgatataatcaattccgtagagacatgactttaatggtactagatttagtggcactatttccaagctatgatacacaaatgtatccaattaaaactacagcccaacttacaagagaagtatatacagacgcaattgggacagtacatccgcatccaagttttacaagtacgacttggtataataataatgcaccttcgttctctgccatagaggctgcggctatccgaagcccgcatctacttgattttctagaacaacttacaatttttagcgcttcatcacgatggagtaatactaggcacatgacttattggcgggggcacacgattcaatctcggccaataggaggcggattaaatacctcaacgcatggggctaccaatacttctattaatcctgtaacattacggttcgcatcacgagacgtttataggactgaatcttatgcaggagtgcttctatggggaatttaccttgaacctattcatggtgtccctactgttaggtttaattttacgaaccctcagaatatttctgatagaggtaccgctaactatagtcaaccttatgagtcacctgggcttcaattaaaagattcagaaactgaattaccaccagaaacaacagaacgaccaaattatgaatcttacagtcacaggttatctcatataggtataattttacaatccagggtgaatgtaccggtatattcttggacgcatcgtagtgcagatcgtacgaatacgattggaccaaatagaatcacccaaatcccaatggtaaaagcatccgaacttcctcaaggtaccactgttgttagaggaccaggatttactggtggggatattcttcgaagaacgaatactggtggatttggaccgataagagtaactgttaacggaccattaacacaaagatatcgtataggattccgctatgcttcaactgtagattttgatttctttgtatcacgtggaggtactactgtaaataattttagattcctacgtacaatgaacagtggagacgaactaaaatacggaaattttgtgagacgtgcttttactacaccttttacttttacacaaattcaagatataattcgaacgtctattcaaggccttagtggaaatggggaagtgtatatagataaaattgaaattattccagttactgcaaccttcgaagcagaatatgatttagaaagagcgcaagagtaa

SEQ ID NO: 191 - DNA, 1845 bp, Bacillus thuringiensis; identical to SEQ ID NO: 183

SEQ ID NO: 192 - DNA, 1848 bp, Bacillus thuringiensis
atgccgaaagtgaataataaaaatcaatgtctgccttataattgtttaaataatcctgaaaatgagatattagatattgaaaggtcaaatagtactgtagcaacaaacatcgccttggagattagtcgtctgctcgcttccgcaactccaataggggggattttattaggattgtttgatgcaatatgggggtctataggcccttcacaatgggatttatctttagagcaaattgagctattgattgaccaaaaaataggggaattcgctagaaaccaggcaatttctagattagaagagataagcagtctgtacggaatttatacagaagcttttagagagtgggaagcagatcctactaatccagcattaaaagaagagatgcgtactcaatttaatgacatgaacagtattcttgtaacagctattcctcttttttcagttcaaaattatcaagtcccatttttatcagtatatgttcaagctgcaaatttgcatttatcggttttgagagatgtttcagtgtttgggcaggcttggggatttgatatagcaacaataaatagtcgttataatgatctgactagacttattcctatatatacagattatgctgtacgctggtacaatacgggattagatcgcttaccacgaactggtgggctgcgaaactgggcaagatttaatcagtttagaagagagttaacaatatcagtattagatattatttcttttttcagaaattacgattctaggttatatccaattccaacaagctcccaattaacgcgggaagtatatacagatccggtaattaatataactgactatagagttggccccagcttcgagaatattgagaactcagccattagaagcccccaccttatggacttcttaaataatttgaccattgatacggatttgattagaggtgttcactattgggcagggcatcgtgtaacttctcattttacaggtagttctcaagtgataacaacccctcaatatgggataaccgcaaatgcggaaccaagacgaactattgctcctagtacttttccaggtcttaacctattttatagaacattatcaaatccttttttccgaagatcagaaaatattacttctaccttagggataaatgtagtacagggagtagggttcattcaaccaaataatgctgaagttctatatagaagtagggggacagtagattctcttaatgagttaccaattgatggtgagaattcattagttggatatagtcatcgattaagtcatgttacactaaccaggtcgttatataatactaatataattagcctgccaacatttgtttggacacatcacagtgctactaatacaaatacaattaatccagatattattacacaaatacctttagtgaaaggatttagacttggtggtggcacctctgtcattaaaggaccaggatttacaggaggggatatccttcgaagaaataccattggtgagtttgtgtctttacaagtcaatattaactcaccaattacccaaagataccgtttaagatttcgttatgcttccagtagggatgcacgaattactgtagcgataggaggacaaattagagtagatatgacccttgaaaaaaccatggaaattggggagagcttaacatctagaacatttagctataccaattttagtaatcctttttcatttagggctaatccagatataattagaatagctgaagaacttcctattcgtggtggtgagctttgtatagataaaattgaacttattctagcagatgcaacatttgaagaagaatatgatttggaaagagcacagaagtaa

SEQ ID NO: 193 - DNA, 1848 bp, Bacillus thuringiensis
atggataataataatcaaaatcaatgcataccttacaattgtttaagtaatcctgaattagagatattagagattgaaagatcaaataataccgtagtagaagacatcaccttggggctgagtcgtctgctcgtttccgcaattccactaggggattttatacttggcctgtttgatgtaatatggggggctttaggtcgttcagagtgggatatatttttagagcaaattgagctattgatcggccaaagaatagaggaatttgctaggaatcaggcaatttctagattagaagggctaagcaatctttatcgaatttacacaaatgcttttaaagactgggaagcagatcctactaatctagaattaaaagaagagatgcgtactcaatttaatgacatgaacagtgcttttacaacagctattcctcttttttcagttcgaggttatgaacttcctcttttatcagtatatgttcaagctgcaaatttacatttatcagttttaagagatgtttcagtgtttggacaacgttggggatttgacgtagcaacagtcaatcgtcgttatgatgatttaactacgaatataggcgactacacagattatgctttaagctggtataatacgggattaaaccgtctaccacgtaatgatgggctgcgaggatgggcaagatttaataggtttagaagagagttaacaatatcagtattagatattatttcttttttccaaaattacgattctagattatatccaattccaacaatctcccaattaacgcgggaagtatatacagatccggtaattaatataactgattatagagttaccccaagtttcgagagtattgaaaactcagcaattagaagcccccatcttatggatttcttaactaatataattattgacactgatttaataagaggtgtttactattgggcaggacatcgtataaattctcgctttaccgggaccgcttttccacatataataacatctcctcaatatggaataactgcaaacgcagaaccaagacgtacaatagcgcctggtccttttcaaggtgccttccctacttatagaacactatcagaccctttcttccgaagatcagacaatattagtccaaccttagggataaatgtagtacagggggtagggttcttacaaccaaataattttgaatctctatatagaaggagagggacagtagattctctcgatgagttgccaattgatggtgaaaatccattagttggatatagtcatcgattaagtcacgttacattaaccaggtcattatttaatactaatataactagcctgccaacatttgtttggacacatcacagtgctactgatacaaatacaattgctccagatgtcattacccaaataccgttagtaaaggctttcaatcttcattcaggtgccacggttgctagagggccaggatttacaggtggggatatccttcgaagaacgaatgttggtaactttggagatatgcgtgtaaatattactgcaccactatcacaaagatatcgagtaaggattcgttatgcttctactacaaatttacgattccatacatcaattaacggaagagctattaatcaggcggattttccagctactatgaatagtgggggtaatttacagtccggaagcttcaggattgcaggttttactactccatttaccttttcagatgcactaagcacattcacaataggtgcttttggcttctcttcaggtaacgaagtttatatagatcgaattgaatttgttccggcagaagtaacctttgaggcagaatatgatctagaaagagcacaaaag

SEQ ID NO: 194 - DNA, 2049 bp, Bacillus thuringiensis
atgcctcgaaataatcaaaatgaatatgaagttattgatgccccacattgtgggtgtccggcagatgatgttgtaaaatatcctttgacagatgatccgaatgctggattgcaaaatatgaactataaggaatatttacaaacgtatggtggagactatacagatcctcttattaatcctaacttatctgttagtggaaaagatgtaatacaagttggaattaatattgtagggagattactaagcttttttggattccccttttctagtcaatgggttactgtatatacctatcttttaaacagcttgtggccggatgacgagaattctgtatgggacgcttttatggagagagtagaagaacttattgatcaaaaaatctcagaagcagtaaagggtagggcattggatgacctaactggattacaatataattataatttatatgtagaagcattagatgagtggctgaatagaccaaatggcgcaagggcatccttagtttctcagcgatttaacattttagatagcctatttacacaatttatgccaagctttggctctggtcctggaagtcaaaattatgcaactatattacttccagtatatgcacaagcagcaaaccttcatttgttattattaaaagatgcagacatttatggagctagatgggggctgaatcaaactcaaatagatcaattccattctcgtcaacaaagccttactcagacttatacaaatcattgtgttactgcgtataatgatggattagcggaattaagaggcacaagcgttgcgagttggctcaaatatcatcaataccgtagggaaatgacagtaacggcaatggatttagtggcattattcccatactataatgttagacaatatccaaatggggcaaatccacaacttacacgtgaggtatatacagatccaatcgtatttaatccgcctgagcgtccaagtggcgctttctgcgaaagtttttatactatccgagcggctcgagaacgtttaactttttcgcaacttgaacatgcaataattcgtccgccgcgcttgtttgaaaggtttcaagctttagggatttatacaggcgaggcgcgactgaatgcaaatagtgctccaatgaactattggattggacattttataagaaatacacgtttaggtgactcaacaacaattactacaaattatggaacaaccaataatcgtttaactaacttcagtatgccttctgatgtttatcaaatcaattcaacctcaagtaatttagccgctattttaggcactttatatggggttactagagcacaattccattttggatcaggaagtttttcgacgtatgtcggacaaaatagcgttcttccacaatgtcatcaaaactataattcaatagaagaattaccaaaccaaagcgatgaacctacagttagaagttatagccatagattatctcatatcacctcttttaatttcaatgtacagcttaataatcctttaatttctgcgggcaatatgcctgtatatgtgtggacacatcgcagtgtggaccttactaacaggatttcttcagatagaattactcaaataccagtggtaaaggcatatgagctaagtagtggtgctactgtcgtgaaaggtccaggattcacaggaggagatgtaatccgaagaacaaatactggtgggttcggagcaataagggtgttggtcactggaccgctaacacaacgatatcgcataaggttccgttatgcttcgacaatagattttgatttctttgtaacacgtggaggaactactataaataattttagatttacacgtacaatgaacaggggacaggaatcaagatatgaatcctatcgtactgtagagtttacaactccttttaactttacacaaagtcaagatataattcgaacatctatccagggacttagtggaaatggggaagtataccttgatagaattgaaatcatccctgtaaatccgacacgagaagcagaagaggatctagaagatgcaaagaaataa

SEQ ID NO: 195 - DNA, 2010 bp, Bacillus thuringiensis
atgcctcgaaataatcaaaatgaatatgaaattattgacgcttccacttgtggttgttcgtcagatgatgttgttcaataccctttggcaagagatccgaatgctgtattccaaaatatgcattataaagattatttgcaaacgtatgatggagactatacaggttctcttataaatcctaacttatctattaatcctagagatgtactgcaaactggaattaatattgtgggaagattactaggatttctaggtgttccatttgctggtcagttagttactttctatacctttcttttaaatcaactgtggccaacaaatgataatgcagtatgggaagcttttatggcacaaatagaagagcttattaatcaaagaatatccgaagcagtagtagggacagcagcggatcatttaacgggattacacgataattatgagttatatgtagaggcattggaggaatggctggaaagaccgaatgctgctagaactaatctactttttaatagatttaccaccctagatagtctttttacacaatttatgccaagctttggtactggacctggaagtcaaaactacgcagttccattacttacagtatacgcacaagcagcgaaccttcatttgttattattaaaggatgctgaaatatatggagcaagatggggactgaaccaaaatcagattaactcattccatacgcgccaacaagaacgtactcaatattatacaaatcattgcgtaacgacgtataataccggtttagatagattaagaggcacaaatactgaaagttggttaaattatcatcgtttccgtagagagatgacattaatggcaatggatttagtagcgctattcccatattataatgtacgacaatatccaaatggagcaaatcctcagcttacacgtgaaatatatacggatccaattgtatttaatccaccagctaatgtgggattatgtagacgttggggcaataacccatataatagattttctgaactagaaaacgcttttatccgcccgccacatctttttgatagattgaataccttaacaattagtagaaatagatttgacgttgggtcaaactttatagaaccgtggtctggacatacgttacgccgtagttattcgaataattcgacagtatatgaagatagttatggccaaattacagccacaagaacaacaattaatctgccggctaatggaactggccgagtagaatcaacagcagtagattttcgtagcgcgcttgtggggatatacggtgttaatagagcttcttttattccaggtggtgtgtttagtggcacgactcagccctctactggaggatgtagagatttgtatgattcaagtgatgaattaccaccagacgaaagtactggaagttttgcccatagactatctcatgttacctttttaagttttacaactaatcaggccggatccatagccaattcaggacgcgtccctacttatgtctggacccatcgcgatgtggactttaataatacaattaaccccaatagaattactcaaataccagtggtaaaggcatatgagctaagtagtggtgctactgtcgtgaaaggtccaggattcacaggaggagatgtaatccgaagaacaaatattggtgggttcggagcaataagggtgtcggtcactggaccgctaacacaacgatatcgcataaggttccgttatgcttcgacaatagattttgatttctttgtaacacgtggaggaactactataaataattttagatttacacgtacaatgaacaggggacaggaatcaagatatgaatcctatcgtactgtggagtttacaactccttttaactttacacaaagtcaagatataattcgaacatctatccagggacttagtggaaatggggaagtataccttgatagaattgaaatcatccctgtaaatccaacacgagaagcggaagaggatctagaagcagcaaagaaataa

SEQ ID NO: 196 - DNA, 1845 bp, Bacillus thuringiensis
atgccaaataggagggaatttatgaataacgaaacacaaaatcaatgcatcccttataattgtttaagtaaccctgaagtggagatattaggaggagacagaagtgctggtattctgccaatacaaatctctctatcgttaacgcgtttccttgctggcgaatttatcccaggagtgggagttgcacttgggttatttgatttaatatggggatttataagtccttctgattgggatcaatttcttgtacggattgaacaattaattgatcaaagaatagaagaattagaaagaactagagcactctctgcattacaaggactagcgaatagttatggggtgtatgttgaagcgcttagagcgtgggaggctgatcctaataatgaagcattaaaggaagatgtgcgtactcgatttactagtattgatggtgatttaatagcagagattcctagatttagacttagaggttatgaggttcctctgttatcggtatatgttcaagcaactaatttacatttatctatgttaagagattctgtaagtcttgggctgcggtggggatttgatattgccacgattaataatcattataacagattaattaataatattcgtgagtatacagattatagtgtgagcacatacaatataggattagaacgcttaaggggaactcgtgttcaagattgggtaaagtttaatcagtttaggagggaactaacacttactgtgttagatattgtttctctttttccaaactatgatgtcagaacatatccaattcaaacagtatcacaattaactagagaaatttatacaaatcctgtatttgaaaattcaccagttaatattaatcttgttaatggctttaatagagttgagtacggagtccgacaacctcatcttatggatcacctcatgaatgtatctatttctgaagaagattatagaggggacaccttttggggaggtcactctattgcctccgtagatacgggtggtaatcttgtcggtttcccgttttatggtaatttcgatagatttcgttttcaaacaatcaacgctcaacaatttcctctttttagaacgttatcagatcctgtttataacctcagtacatctggagggagaaacagactatttgctcttgaagggataggatttcaacaggctgtaacgggaaccacacgagcttttaggagagtcggaacaatagattctcttattgaaataccacctcaagatgaaagtgaagtaccttggaatggctatagtcatgtattaaatcatattacatttataaattggccagctgttttcctacaaggggaaagaatagcttctccaatgttttcttggacacatcgtagtgcagatcgtatcaatagaattattccagatgttatcaatcaaattccagctgttaaaggcagctctattattaatggaactgtaatttcaggaccaggatttactggaggagatttagttagattagaaaataatgcataccttgaaattccagtgcaatttcaaacaacatctacaaattatcgagttcgtgtacgttatgcctccacctctcaagcatctataagtgtagtttttggaaatatagatcatcctagtaccataccagccacagctgaatcattagacaatctacaatataacgattttgattattttgatgttattggtactttcttaccttcattaggcggtagtttagcttttagaactttaagttcgaatgcaaatgtggtaatagatagattcgaatttatcccagttactgcaacatttgaggcagaatatgatttagaaaaagcgcaagagtaa

SEQ ID NO: 197 - DNA, 1866 bp, Bacillus thuringiensis
atgccgataatgaataatcagaattattgcattccttataattgtttgaataatcctgcactcgaaatattagaagaagaaagaatatcagttggtaatacaccaatcgatatttccctgtcgcttacgcagtttcttttgagtgaatttgtcccaggtgcggggtttgtattaggtttatttgatttaatatggggatttgtaggcccctctcaatgggatgcatttcttgtgcaaattgaacagttaattaaccaaagaatagaggaattcgctaggaaccaagcaatttctagattagaagggctaagcaatctttaccgaatttactcagaagcttttagagaatgggaagcagatcctactaatccagcgttaagagaagaaatgcgtattcaattcaatgacatgaacagtgctcttgtaacagctcttcctcttttttcagttcaaaattatcaagttcctcttttatcagtatatgttcaagctgcaaatttacatttatcggttttgagagatgtgtcagtgtttggacaacgttggggatttgatgtagcgacaatcaatagtcgttataatgatttaactaggaatattggcgaatatacagattatgctgtacgctggtacaatacgggattagaacgtgtatggggaccggattccagagattgggtaagatataatcaatttagaagagaactaacactaactgtattagatattatttctctatttccgaactatgatagtagaacgtatccaattcgaacagttgcccaattaacaagagaaatttatacaaacccagtattagaaaattttgatggtaattttcgtggaatggctcagagaatagaacagaatattaggcaaccacatcttatggatatccttaatacaataaccatttatactgatgtgcatagaggctttaattattggtcaggacatcaaataacagcttctcctgtcggttttgcggggccagaaattacttttcctagatatggaaccatgggaaatgcagctccacccgtacttgtctcattaataggtttggggatttttagaacattatcatcacctctttacagaagacttatacttggttcaggcccaaataatcaggaactgtttgtccttgatggaacggaattttcttttgcctccctcacgaccaatctaccttctactatatacagacaaaggggaacggtcgattcactagatgtaataccgccacaggataatagtgtgccagctcgtgcgggatttagtcatcgattaagtcatgttacaatgctgagccaagcagctggagcagtttacaccttgagagctccaacgttttcttggcagcatcgcagtgctgaattcagtaaccaaattccctcatcacaaattacacaaatacctttaacaaagtctattaatcttggctctgggaccactgtcgttaaagggccaggatttacaggaggagatattcttcgaagaacttcatctggcgaaatttcaactttaagagtaactattactgcaccattatcacaaagatatcgcgtaaggattcgttatgcttctactacaaatttacaattcaatacagtaattaacggaagatccattaatcaggcgaattttccagcaactatggataatggggaaaatttacaattcgaaaacttcagaactgtaggttatactactccttttagcttttcagatgcatcaagtatatttacattaactgctcggaacttctcttcaggtaacgaagtttatatagatcgaattgaatttgttccagcagatgcaacattagaggcagaatatgatttagaaagagcgcaaaagtaa

SEQ ID NO: 198 - DNA, 1971 bp, Bacillus thuringiensis
atgccttcaaataggaaaaatgagaatgaaattataaatgccttatcgattccagctgtatcgaatcattccgcacaaatggatctatcgctagatgctcgtattgaggattctttgtgtatagccgaggggaataatatcaatccacttgttagcgcatcaacagtccaaacgggtataaacatagctggtagaatattgggcgtattaggtgtgccgtttgctggacaactagctagtttttatagttttcttgttggggaattatggcctagtggcagagatccttgggaaattttcctggaacatgtagaacaacttataagacaacaagtaacagaaaatactaggaatacggctattgctcgattagaaggtctaggaagaggctatagatcttaccagcaggctcttgaaacttggttagataaccgaaatgatgcaagatcaagaagcattattcttgagcgctatgttgctttagaacttgacattactactgctataccgcttttcagaatacgaaatgaagaagttccattattaatggtatatgctcaagctgcaaatttacacctattattattgagagacgcatccctttttggtagtgaatgggggatggcatcttccgatgttaaccaatattaccaagaacaaatcaggtatacagaggaatattctaaccattgcgtacaatggtataatacagggctaaataacttaagagggacaaatgctgaaagttggctgcggtataatcaattccgtagagacctaacgttaggggtattagatttagtagccctattcccaagctatgatactcgcacttatccaatcaatacgagtgctcagttaacaagagaaatttatacagatccaattgggagaacaaatgcaccttcaggatttgcaagtacgaattggtttaataataatgcaccatcgttttctgccatagaggctgccattttcaggcctccgcatctacttgattttccagaacaacttacaatttacagtgcatcaagccgttggagtagcactcaacatatgaattattgggtgggacataggcttaacttccgcccaataggagggacattaaatacctcaacacaaggacttactaataatacttcaattaatcctgtaacattacagtttacgtctcgtgacgtttatagaacagaatcaaatgcagggacaaatatactatttactactcctgtgaatggagtaccttgggctagatttaattttataaaccctcagaatatttatgaaagaggcgccactacctacagtcaaccgtatcagggagttgggattcaattatttgattcagaaactgaattaccaccagaaacaacagaacgaccaaattatgaatcatatagtcatagattatctcatataggactaatcataggaaacactttgagagcaccagtctattcttggacgcatcgtagtgcaactaatacaaatacaattaatccagatattattacacaaatacctttagtgaaaggatttagacttggtggtggcacctctgtcattaaaggaccaggatttacaggaggggatatccttcgaagaaataccattggtgagtttgtgtctttacaagtcaatattaactcaccaattacccaaagataccgtttaagatttcgttatgcttccagtagggatgcacgaattactgtagcgataggaggacaaattagagtagatatgacccttgaaaaaacgatggaaattggggagagcttaacatctagaacatttagctataccaattttagtaatcctttttcatttagggctaatccagatataattagaatagctgaagaacttcctattcgtggtggtgagctttatatagataaaattgaacttattctagcagaggtaacatttgaggcagaatatgatttagaaagagcacaaaagtaa

SEQ ID NO: 199 - DNA, 1650 bp, Bacillus thuringiensis
atgccggatacaatcatcctgcagacaattgcggcaaacatcggtagtagcttgatgcctatgggaaacccacaaaatttatacctatattcttactatggaattaagctcatcccatttttaggttcaatcctgcttttagctgtacttggaattagtttgttatttatatttactcaaaaacttcaaaaaacagatttgaaaatagaactacctgttattaccgtgaaaaatcgaaaaaaagctaccgtctggattttgatacttatcactatcattgcatctatttttggaaaagagtggggattatcatcttcagaaatttcaacattttataaccgtcaagtcgaacgagcaggagattattccgaccattgtgtgaaatggtatagcacaggtctaaataacttgaggggtacaaatgccgaaagttgggtacgatataatcaattccgtagagacatgactttaatggtactagatttagtggcactatttccaagctatgatacacaaatgtatccaattaaaactacagcccaacttacaagagaagtatatacagacgcaattgggacagtacatccgcatccaagttttacaagtacgacttggtataataataatgcaccttcgttctctgccatagaggctgctgttgttcgaaacccgcatctactcgattttctagaacaagttacaatttacagcttattaagtcgatggagtaacactcagtatatgaatatgtggggaggacataaactagaattccgaacaataggaggaacgttaaatatctcaacacaaggatctactaatacttctattaatcctgtaacattaccgttcacttctcgagacgtctataggactgaatcattggcagggctgaatctatctttaactcaacctgttaatggagtacctagggttgattttcattggaaattcgtcacacatccgatcgcatctgataatttctattatccagggtatgctggaattgggacgcaattacaggattcagaaaatgaattaccacctgaagcaacaggacagccaaattatgaatcttatagtcatagattatctcatataggactcatttcagcatcacatgtgaaagcattggtatattcttggacgcatcgtagtgcagatcgtacaaatacaattgagccaaatagcattacacaaataccattagtaaaagctttcaatctgtcttcaggtgccgctgtagtgagaggaccaggatttacaggtggggatatccttcgaagaacgaatactggtacacttggggatatacgagtaaatattaatccaccatttgcacaaagatatcgcgtgaggattcgctatgcttctaccacagatttacaattccatacgtcaattaacggtaaagctattaatcaaggtaatttttcagcaactatgaatagaggagaggacttagactataaaacctttagaactgtaggctttaccactccatttagctttttagatgtacaaagtacattcacaataggtgcttggaacttctcttcaggtaacgaagtttatatagatagaattgaatttgttccggtagaagtaacatatgaggcagaatatgattttgaaaaagcgcaagagtaa

SEQ ID NO: 200 - DNA, 1956 bp, Bacillus thuringiensis
atgccaccaaataaccaggataatcatgaaaccttatccaacaaagtgacagtcgaaaaaccttttacagattcactaaaaaatgaaacaactaaaaatagtaattatgaagattgtttgaaaatgtctagacatgaaagcgtagagccgtttgttagtgtatcaacaattcaaacgggaattggtattgctggtaaaatccttggtagcctaggcgttccttttgctgggcaagtagctagcctttatagttttattctaggtgagctttggcctaaggggaaaagtcaatgggaaatctttatggaagatgtagaaaaacttgttgatcaaaaaatatcgatttacgcaagaaacaaagcacttgcagatttaaaaggattaggagatgctctggctgtctaccatgaatcccttgaaagttggattgaaaatcgtaataacagaagagctagaagtgttgttaaagaccaatatatcgctttggaacttatgtttgttcagagacttccttcttttgcagtatctggagaagaggtgccgctattaccaatttatgctcaagctgcaaatttacacttattgctattaagagatgcatcaatttttggagaagaatggggtttttcaacttcagaaatttcaacattttataaccgccaatctagtcggacgatagaatattctgactattgctcaggatggtataatacaggactaaatcgcttgagaggtgcaaatgctgaaagttgggtacgatataatcaattccgtagagacatgactttaatggtactagatctagtagcactattcccaagctatgacactcgcacttatccaattaaaactagtgcccaacttacaagagaagtctatacagatccaaacggtattgtagcaggaggcaataataattggtttagaaatggggcttcgttttccactatagaaaacgcaattattcgacaacctcacctatatgattttctaacgaaccttacaatttacacgagaataagtcgagcaaaccctgcttatatgaatttgtgggcagggcatagaattacttctaatagaataggttctagtaatagtagtgaattggtgtatggggctataactaatccagttagtactactaacttatcatttgtcaatcgggatgtttaccgaactgaatcattagctggtgggcttggcactctgaatggaatactttatggtttaactagagttgattttgatatgatatttcgtaaccgtcctgatatagtaactggattattttatcatccgggacacgcgggcattgcaacccaagtaaaagattcagaaacagaattaccacctgaaacgacagaacagccaaattatagagcatttagtcatctactaagtcatatttcaatgggtccaacgactcaagacgtacctccagtatattcttggacacaccagagtgcagaccgttcaaatacaatcgattcggataggataacacaaataccattggtaaaggcgcatacccttcaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactgacttaagaatttacgtaacggttgcaggcgaacgaatttatgctggtaaatttaataaaaccatgaaaaaaggtgacccattaacattccaatcatttagttacgcaactattaatacagcttttacattcccagaaagatcgagcagcttgactgtaggtgctgatacgttcgattcaggtaatgaagtttatgtagatagatttgaattaatcccggatactgtaacatttgaggcagagtctgatttagaaaaagcgcaaaagtaa

SEQ ID NO: 201 - DNA, 1977 bp, Bacillus thuringiensis
atgccactaaagaatcaagataagcatcaaagtttttctagcaatgcgaaagtagataaaatcgctacggattcactaaaaaatgaaacagatatagaattgaaaaatatgaataatgaagattatttgagaatgtctgagcatgagagtattgatccgtttgttagtgcatcaacaattcaaacgggtattggaattgctggtaaaatccttggtactctaggtgttccctttgctgggcaaatagctagcctctatagttttatcctaggcgagctttggccaaaggggaaaagtcagtgggaaatctttatggaacatgtagaagagcttattgcacaaaaaatatcaacttacgcaagaaacaaagcactcacagatttaaaaggtttaggagatgctttggctgtttaccatgagtcacttgaaagttggattaaaaatcgcaataacacaagggctagaagtgttgttaagagccaatatatctctctagaacttatgtttgttcagaagctgccttcctttgcggtatctggggaagaagttcctctattaccaatatacgcccaagctgcaaatctacacttgttgctattaagagatgcatctatttttggaaaagagtggggattatcatcttcagaaatttcaacattttataaccgtcaagccgaaagaacgagtgactattccgaccattgtgtgaaatggtatagtacaggtctaaataacttgaggggtaaaaatgccgaaagctgggttcgctataatcaatttcgtaaagatatgatattaatggtactagatttagtggcactattcccaagttatgatacacatatgtatccaattaaaactacagcccaacttactagagaagtatatacaaacgcaattgggacagtacatccgcatccaagttttgcaagtacgacttggtataataataatgcaccttcgttttctgccatagaggctgccgttatccgaagcccgcacctactcgattttctagaacaagttacaatttacagcttattaagtcggtggagtaacactcagtatatgaatatgtggggagggcatagacttgaattccgaacaataggaggagcattaaatacctcaacacaaggatctactaatacttctattaatcctgtaacattaccgttcacgtctcgagacgtctataggactgaatcattggcagggctgaatctatttttaactcaacctgttaatggagtacctagggttgattttcattggaaattcgtcacacatccgatcgcatctgataatttctattatccagggtatgctggaattgggacgcaattacaagattcagaaactgaattaccacctgaaacaacaggacagccaaattatgaatcatatagtcatagattatctcatataggactcatttcagcatcacatgtgaaagcattggtatattcttggacgcatcgtagtgcagatcgtacaaatacaattgagccaaatagcattacacaaataccattagtaaaagcattcaatcttccttcaggtgccgctgttgttagaggaccaggatttacaggtggggatatccttcgaagaacaaatactggtacatttggggatatacgagtaaatattaatccaccatttgcacaaaggtatcgcgtaaggattcgttatgcttctactacagatgtacaattccatacgtcaattaacggtaaagctattaatcaaggtaatttttcagcaactatgaatagaggagaggacttagactataaaacctttagaactgtaggatttactactccatttagcttttcggatgtacaaagtacattcacaataggtgcttggaacttctcttcaggtaacgaagtttatatagatagaattgaatttgttccggtagaagtaacatatgaggcagagcatgattttgaaaaagcgcaagagtaa

SEQ ID NO: 202 - DNA, 1830 bp, Bacillus thuringiensis
atgccctcaaatgaacatgattatttgaaagtttgtgatgatttaagtgaaactaatatggagaggtttgacaaaaatgatgcactggagattggtatgtctattgtatctgaacttcttggcatgattccaggcggagcagccttacaatttgtgtttaatcaattgtggtcgcgtttaggtgattctggatggagtgcattcatggaacatgttgaagaattaattgatactaaaatagaagggtatgcaaaaaataaagccttatctgagttagcaggtatgcacagaaatcttgaaacatatataaaattgcttaatgaatgggaaaataatactggaagttcaaaagcacaaggtagagtagctaattattttgaaagtcttgagcaggcggttgaaagaggtatgcctcaattcgcagttggtaatttcgaaataccccttttaactgtttatgtacaagctgctaaccttcatttattgttattaagagatgtttcagtttatggaaaacgctggggatggtcagatcagaaaattaagatttattatgagaaacaagttaagtatactcatgaatacaccaatcattgttcgacttggtataatagaggactagataaattgaaaaataagggttcttcttaccaagattggtacaactataatcgtttccgtagagaaattactcttactgttctagatatcgtcgctgtattcccacactatgatgtgaaagcttatccaattcaaacagttggccaattaacaagggaagtttatacagaccctttaattaattttaatccgcaactagattctgtatctcaattacctacttttagtgatatggaaaatgcaacaattagaaccccacatctgatggagtttttaagaatgctaacaatctatacagattggtatagtgtgggaagaaactattattggggaggacatcgagtgacttcttaccgtgtaggaggagaaaatataacctcccctttatatggaagtgaggcaaatcaagagctgcctagacaactgtatttttatgggccggtttttagaacattatcaaatcctactttaagatacttacagcaacctgcgccagctccgccgtttgctttacgtcgcttagaaggagtagaatttcacaccactacaggtactgatatgtatcgtgaaagaggatcggtagattcttttaatgagctaccgccttttaatccagttggactacctcgtaatgcatatagtcaccgtttatgtcatgcaacgtttgtccgtaaatctgggaccccttatctaataaccggtactgtcttttcttggacacatcgtagtgctgaagaaaccaatacaattgattcaaatagaatcacgcaaattccattggtgaaagcatatcaaattagctcgggcactactgtgaggagaggtccaggattcacaggaggcgatatacttcgaagaactggtcccggtacatttggggatataaaactaaatatcaattcaccattatctcaaagatatcgcgtaaggattcgttatgcttctactactgatttacaatttttcacgaatattaatggaactaccattaatatgggtaatttcccaaaaaccgtgaataattcgagttctgaaggctatagaactgtatcatttagtactccatttagcttttcaaatgcacaaagtatatttagattaggtatacaagctttttctggagtccacgagattcacgttgatagaattgaatttgtcccggcagaggtaacatttgaggcagagtatgatttagaaagggcgcaaaag

SEQ ID NO: 203 - DNA, 1866 bp, Bacillus thuringiensis
atggcttataataataatcaaaatcaatgcataccttataattgtttgaataatcccgaaatcgaaatattagaaggcggaagaatatcagttggtaataccccaattgatatttctctttcgcttactcagtttcttttgagtgaatttgtcccaggtgcggggtttgtattaggattaattgatttaatatggggatttgtaggtccttcccaatgggacgcatttcttgctcaagtggaacagttaattaaccaaagaatagcagaagctgtaagaaatacagcaattcaggaattagagggaatggcacgggtttatagaacctatgctactgcttttgctgagtgggaaaaagctcctgatgacccagagctaagagaagcactacgtacacaatttacagcaactgagacttatataagtggaagaatatccgttttaaaaattcaaacttttgaagtacagctgttatcagtgtttgcccaagctgcaaatttacatttatctttattaagagacgttgtgttttttgggcaaagatggggtttttcaacgacaaccgtaaataattactacaatgatttaacagaagggattagtacctatacagattatgctgtacgctggtacaatacgggattagaacgtgtatggggaccggattctagagattgggtaaggtataatcaatttagaagagaattaacactaactgtattagatatcgttgctctgttcccgaattatgatagtagaagatatccaattcgaacagtttcccaattaacaagagaaatttatacaaacccagtattagaaaattttgatggtagttttcgaggctcggctcagggcatagaaagaagtattaggagtccacatttgatggatatacttaacagtataaccatctatacggatgctcataggggttattattattggtcagggcatcaaataatggcttctcctgtcggtttttcggggccagaattcacgtttccgctatatggaaccatgggaaatgcagctccacaacaacgtattgttgcccaactaggtcagggcgtgtatagaacattatcctctactttttatagaagaccttttaatatagggataaataatcaacaactatctgttcttgacgggacagaatttgcttatggaacctcctcaaatttgccatccgctgtatacagaaaaagcggaacggtagattcgctggatgaaataccaccacagaataacaacgtgccacctaggcaaggatttagtcatcgattaagccatgtttcaatgtttcgttcaggctctagtagtagtgtaagtataataagagctcctatgttctcttggatacatcgtagtgctgaatttaataatataattgcatcggatagtattactcaaatccctgcagtgaagggaaactttctttttaatggttctgtaatttcaggaccaggatttactggtggggacttagttagattaaatagtagtggaaataacattcagaatagagggtatattgaagttccaattcacttcccatcgacatctaccagatatcgagttcgtgtacggtatgcttctgtaaccccgattcacctcaacgttaattggggtaattcatccattttttccaatacagtaccagctacagctacgtcattagataatctacaatcaagtgattttggttattttgaaagtgccaatgcttttacatcttcattaggtaatatagtaggtgttagaaattttagtgggactgcaggagtgataatagacagatttgaatttattccagttactgcaacactcgaggctgaatataatctggagagagcgcagaag

SEQ ID NO: 204 - DNA, 1839 bp, Bacillus thuringiensis
atggagagaaataatcagaatcaatgcattccttataattgtttaaataatcttgagagtgagatattagatattgaaagtttaagtagtagaagtagagaacaagtagcggaaatcagcttggggctcacgcgctttcttttggagtcactgctccctggtgcgagttttggatttggtttatttgatatcgtttggggagttattggtcctgatcaatggagcctatttcttgcgcagattgaacaattaattgatcaacgaatagaaacacatgtaagaaatcaagcgatcagtagattagaggggcttggagatagttatgaagtgtatattgaggcgcttagagaatgggaggcgtctcctaataatgaatccttacagcaagatgtgcgcaatcgatttagtaataccgataatgccttaataaacgcgatacctattttgagagagcagggctttgaaattcctcttttaacgacttatgttcaggctgccaatttgcatttatctttattaagagatgctgtatattttggacagagatggggacttgacacagctacggttaacaatcattataatcggttaattaatcttattaacgcttactccgatcattgtgctcaatggttcaatagagctctaaataattttggtgttgtatcaagtaggtatttggatttccaaagagaggtaacaatatctgttttagatatcgttgctcttttcccgaattatgacattcggacatatccaatcccaacactaagtcaattaacaagagaaatttatacatctccagttgctgaacctggtgcaagtcttaatgtggatttacggaatatattgagagaacctcacctaatggattttttaactcgcctcgttatttataccggtgtgcagagtggtatttaccattgggcaggacatgaaatatcttctaggactacaggtaatttgtcgagtaatatacaatttccgctatatggaatagccgcaagtgcagataggccagttaatttgacaattcactattctgaaactatttatagaacattatcagctcctatctattcaatatctggtgggatttctcctaatagaacgagagtagtggagggagtaaggttcttaattgcgagagataataatatgaattccttgccatttttatatagaaaagagggttctctagattcttttaccgagttaccacctgaagatgagaatgcaccaccttatattgggtatagtcatcggttatgccatgctagatttgctaggtcatctgtagtagctgaaccaagtaatttcgcaaggcttccagtattttcttggacacatcgtagtgctggccctactaatgaagtaagttcatctagaataacacaaatcccatgggtaaaagcacatacccttgattcgggagcctctgttattaagggccctggatttacaggaggggacattcttactaggcctaactttggtaccttgggagctttaggagtaacttttacagggcgattatcacaaagatacaatataagaatccgatatgcttctgtagcaaatcggagtggtacatttagctattcactgccaccttcgtatggaatttcatttccaaaaactatggacgcaggtgaaccattaacacctcgttcgttcgctcttacaacgctcttcactccaataaccttttcgcgagcgcaagaagaatttaatctattcatccagcagggtgtttatatagacagaatagaatttgttccagttgatgaaacatttgaagcagaatatgatttagaaagagcacaaaagtaaggatcc

SEQ ID NO: 205 - DNA, 1977 bp, Bacillus thuringiensis
atgccatctaagaatcaaaatatgtatcaaagtttgtctagcaatacgacagttgataaaaactttacaaattcactagaaaacaacacaaatatggaattacaaaatattaattatgaagattgtttgagaatgtctgagtatgaaggtatagagccgtttgttagtgtatcaacaattcaaacaggtattggtattgcgggtaaaatacttggtaccctaggcgttccttttgcaggacaagtagctagtctttatagttttatcttaggtgagctatggcctaaggggaaaagccaatgggaaatctttatggaacatgtagaagagattattaatcaaaaaatatcaacttatgcaagaagtaaagcacttacagacttgaaaggattaggagatgccttagctgtctaccatgaatcgctggaaagttgggttggaaatcgtaataacacaagggctaggagtgttgtcaagagccaatatatcgcattagaattgatgttcgttcagaaactaccttcttttgcagtgtctggagaggaggtaacattattaccgatatatgcccaagctgcaaatttacatttgttgctattacgagatgcgtctatttttggaaaagagtggggattatcatcttcagaaatttcaacattttataaccgtcaagtcgaacgagcaggagattattccgaccattgtgtgaaatggtatagcacaggtctaaataacttgaggggtacaaatgccgaaagttgggtacgatataatcaattccgtagagacatgactttaatggtactagatttagtggcactatttccaagctatgatacacaaatgtatccaattaaaactacagcccaacttacaagagaagtatatacagacgcaattgggacaatacatccgcatccaagttttacaagtacgacttggtataataataatgcaccttcgttctctgccatagaggctgctgttgttcgaaacccgcatctactcgattttctagaacaagttacaatttacagcttattaagtcgatggagtaacactcagtatatgaatatgtggggaggacataaactagaattccgaacaataggaggaacgttaaatacctcaacacaaggatctactaatactgctattaatcctgtaacattaccgttcacttcacgagacgtctataggactgaatcattggcagggctgaatctatttttaactcaacctgttaatggagtacctagggttgattttcattggaaattcgtcacacatccgatcgcatctgataatttctattatccagggtatgctggaattgggacgcaattacaggattcagaaaatgaattaccatctgaagcaacaggacagccaaattatgaatcttatagtcatagattatctcatataggactcatttcagcatcacatgtgaaagcattggtatattcttggacacatcgtagtgcagatcgtacaaatacaattgagccaaatagcattacacaaataccattagtaaaagcgttcaatctgtcttcaggtgccgctgtagtgagaggaccaggatttacaggtggggatatccttcgaagaacgaatactggtacatttggggatatacgagtaaatattaatccaccatttgcacaaagatatcgcgtgaggattcgctatgcttctactacagatttacaattccatacgtcaattaacggtaaagctattaatcaaggtaatttttcagcaactatgaatagaggagaggacttagactataaaacctttagaactgtaggctttaccactccatttagcttttcagatgtacaaagtacattcacaataggtgcttggaacttctcttcaggtaacgaagtttatatagatagaattgaatttgttccggtagaagtaacttatgaggcagaatatgattttgaaaaagcgcaagagtaa

SEQ ID NO: 206 - DNA, 2056 bp, Bacillus thuringiensis
atgggaggaaaagggatgaatcgaaataatcaaaatgaatatgaagttatttatgctgccacttgtgggtgcccgtcagatgatgttgtaaaataccctttggcaagtgatccaaatgcctcgttacaaaatatcaattataaagattatttgaaaatttccgaaggagactatatagattcgtatataaatcctggcaatgttagaactggactacaaactggaattgatattgtagcattgctagtagggactttaggtggaccggttggtggcatacttactggtttgctttccactctttttggttttctctggccatctaatgatcaagcagtatgggaagcatttatagaacaaatggaagaactgattgaacaacggatatcagaccaagtagtaaggactgcactggatgatttaacgggaattcaaaattattacaatcaatatttattagcattggaggagtgggaagaaggaccaaacagtgtaagagctaatctagttttgcagagatttgaaaacctacatgcgctatttgtaagtaatatgcccagctttggcagtggtcctggaagtcaaagatttgaggcacaattgctgatagtttatgcacaagcagcaaatcttcatttgttattattaagagatgctgaaatatatggagcaagatggggacttcgtgaatctcaaattgaattatattttgatgagctacaaaataatactcgtgattataccaatcattgtgtgaacgcgtataataacgggttagagaaggtacgaggaacaaacgctgcaagttggttgaagtaccatcaattccgtcgagaggcgaccttgacggcgatggatttggtggcgctatttccatattataacttacgacaatacccaatagcagtaaatccccagctcacgcgtgaggtatatacagatccattaggtgttccgtttgaagaatcgaatccatttccagaaatcagatgttcaagatggcaagaaacttctgccatgactttttcgaatttggaaaatgcaatagttcgtccaccacatttatttgatataataagaaatttaaggatttatactggtacttttaggttcaataacaataaccttattgaagggtggattggacattctgtaactaataatcgcctgggaatttcaacagaattcacaagcaattacggtatcactacacctattataaacagttataattttgctaatcgtgatgtttatcaaattaatacaagatcaaatacttcgttgattgcatttcaaaacgcacctttatttggaatcactagggctcaatttcagccaggtgggacctattcagtaaatcaacgaacttctttgttatgtgagcaaaattataattcaactgatgagttaccgagtctagacccggatgaacctatcagtagaagttatagtcatagattatcacatattacctcttatttgcatcgtgtacttactattgatggtattaatatatattcaggtaatcttcctacttatgtttggacgcatcgagatgtggaccttactaatacaattaccgctgacagaattacacacttaccattaataaaatcaaatgtacaacgcagtggccgccctgtaaaaggaccaggatttacaggaggagatgtacttcgaatatcatcaagtgatgctgatatatcaataataggagtatcggctggtgcaccactaacacaacaatatcgtataagagcgcgttatgcttcaaatgtagatgttactatccgtttcataagacacaacacccaaagtgttataggaagcgctagcttatcaagtacaatgaatagcggagaggagtcaagatatgaagcgtatcgtactgtagaggtaattagtaattttagattaaatagcagttcagaacagatccgaatagttactcaaggacttcgtgcaaatggacaattgtatcttgatagccttgaatttatccctgtaaatccaacacgagaagcagaagaggatttagaagcggcgaagaaataag

SEQ ID NO: 207 - DNA, 1956 bp, Bacillus thuringiensis; identical to SEQ ID NO: 200

SEQ ID NO: 208 - DNA, 2055 bp, Bacillus thuringiensis
atgcctcgaaataatcaaaatgaatatgaagttattgatgccccacattgtgggtgtccggcagatgatgttgtaaaatatcctttgacagatgatccgaatgctggattgcaaaatatgaactataaggaatatttacaaacgtatggtggagactatacagatcctcttattaatcctaacttatctgttagtggaaaagatgtaatacaagttggaattaatattgtagggagattacttagcttttttggattccccttttctagtcaatgggttactgtatatacctatcttttaaacagcttgtggccggatgacgagaattctgtatgggacgcttttatggagagagtagaagaacttattgatcaaaaaatctcagaagcagtaaagggtagggcattggatgacctaactggattacaatataattataatttatatgtagaagcattagatgagtggctgaatagaccaaatggcgcaagggcatccttagtttctcagcgatttaacattttagatagcctatttacacaatttatgcctagctttggctctggtcctggaagtcaaaattatgcaactatattacttccagtatatgcacaagcagcaaaccttcatttgttattattaaaagatgcagacatttatggagctagatgggggctgaatcaaactcaaatagatcaattccattctcgtcaacaaagccttactcagacttatacaaatcattgtgttactgcgtataatgatggattagcggaattaagaggcacaagcgttgcgagttggctcaaatatcatcaataccgtagggaaatgacagtaacggcaatggatttagtggcattattcccatactataatgttagacaatatccaaatggggcaaatccacaacttacacgtgaggtatatacagatccaatcgtatttaatccgcctgagcgtccaagtggcgctttctgcgaaagtttttatactatccgagcggcacgagaacgtttaactttttcgcaacttgaacatgcaataattcgtccgccgcgcttgtttgaaaggtttcaagcattagggatttatacaggcgaggcgcgactgaatgcaaatagtgctccaatgaactattggattggacattttataagaaatacacgtttaggtgactcaacaacaattactacaaattatggaacaaccaataatcgtttaactaacttcagtatgccttctgatgtttatcaaatcaattcaacctcaagtaatttagccgctattttaggcactttatatggggttactagagcacaattccattttggatcaggaagtttttcgacgtatgtcggacaaaatagcgttcttccacaatgtcatcaaaactataattcaatagaagaattaccaaaccaaagcgatgaacctacagttagaagttatagccatagattatctcatatcacctcttttaatttcaatgtacagcttaataatcctttaatttctgcgggcaatatgcctgtatatgtgtggacacatcgcagtgtggaccttactaacaggatttcttcagatagaattactcaaataccagtggtaaaggcatatgagctaagtagtggtgctactgtcgtgaaaggtccaggattcacaggaggagatgtaatccgaagaacaaatactggtgggttcggagcaataagggtgttggtcactggaccgctaacacaacgatatcgcataaggttccgttatgcttcgacaatagattttgatttctttgtaacacgtggaggaactactataaataattttagatttacacgtacaatgaacaggggacaggaatcaagatatgaatcctatcgtactgtagagtttacaactccttttaactttacacaaagtcaagatataattcgaacatctatccagggacttagtggaaatggggaagtataccttgatagaattgaaatcatccctgtaaatccaacgcgagaggcggaagaggatttagaagcggcgaagaaataaggatcc

SEQ ID NO: 209 - DNA, 2046 bp, Bacillus thuringiensis
atgccccgaaataatcaaaatgattatgaagttattgacgcttccaattgtggttgtgcgtcaggtgatgttgtgaaatatcctttgacaaatgatccgaatgccggattacaaaatatcaattataaagagtacttacaaatgtcagatgagaactacactgattcctatataaatcctagtttgtctattagtgggaaatctgtaatacaagttggaattaacattgtagggaggttgttgagcttttttggattcccatttgctaatcaagtggtcgctgtctatagctaccttttaaacaccttatggccaaataatgatactgaagtatgggaatcttttatggcacaagtagaagaacttgttgatcaaaaaatatcagaagcggtagtagggaccgcattggatcatttatctggattaaactataattatgaattatatgtagaggctttggaagagtggctggaaagaccaaatgccgcaagagccaacctagtttttaatagatttactacactagatagtctatttacgcaatttatgccaagttttggctctggtcctgggagtaataggtatgcagattcattactttcagtatatgcacaagcagcaaaccttcatttgttattcttaaaagatgcagacatttatggagctagatgggggctgaatcaaactcaaatagatcaataccataatcgtcaacaaacccttactcggaattatacaaatcattgtgttactacgtttaatgatggattagagaaaataagaaacacaagcgctgagagttggtttaaatacaatcaatatcgtagagagatgacattaatggcaatggatttagtggcattatttccgtattataatgtacgagaatactcaatggcagtaaatcctcaacttacacgagaggtgtatacagatccaattgcatttgatccatcagaacaaccgaatactcaattgtgtcgaaaatggtatactgcccgctttgtacagaataacgttaatttttctcagttagaaaatgcattcattcgttcaccacatctcttcgaaagattacattctctggaaattaattttataaatggagctaattggtggtggcataaggtaaggaaccaacttttaaataattcattaatactcgaaagagattacggtacatctactgttaattctcctacgactcaacttaccgtgaatacttcaaatgctgatatataccaagtacgttctcgtgcagaaaatccgactgcagctgcaggtacttactattcagttagaggtgttgagttttatttaagctcaggcgttaagagggagttttctggaactacagtcgctcctttggcttgccaagaattgcgaaattcaattgatgagttaccaagtttagaaccaaatgagcctatcatcagaaattatagtcatagattatctcatattacttggtaccaatttagtggccgccaaagtggaaatccgactactaataatggggatatacctacttatgtctggacacatcgcgatgtggactttaataatacaattactcccaatagaattactcaaataccatggataaaggcatctgaaatagctgcgaatactactgtcgtaaaaggcccaggatttacaggaggggatatacttcgaagcacgatccctggtacagttggaacgattagggctaatgttatggccccattaacacaacaatatcgtataagattacgttatgcgtcgacaacaaattttgttgttaatttatttgttaacaattcagctagtggttttactctcccaagtacaatggttcaaaatgagtctttaacatacgaatcgtttaataccgaagaggtgacaagaactattagattttcacagtcagacactacactgagattgggtatattttcgtttgaccctggtcaagaagtgtatgtagataaacttgaaatcgttccaattaatccagctcgtgaggcggaagaggatttagaagcagcgaaaaaataaggatcc

SEQ ID NO: 210 - DNA, 1956 bp, Bacillus thuringiensis
atgccaccaaataaccagaataatcatcaaaccttatctagcaatatgacagttaataaaacttctacagattcactaaaaaatgaaacaactatggaattgaaaaatagtaattataaagattgtttaaaaatgtcagaacatgaaagtatagaaccgtttgttagtgtatcaacaattcaaacgggaattggtattgctggtaaaatccttggtagcttaggcgttcctttttctgggcaagtagctagcctctatagttttatcctaggtgagctttggcctaaggggaaaagccaatgggaaatctttatggaacatgtggaagagcttgttgcccaaaaaatatcgacttacgcaagaaacaaagcacttgcagatttaaaaggattaggagatgctctagctgtctaccatgaatcccttgaaagctggattaaagatcgcaataacacaagagttagaagtgttgttaaaaaccaatatattaatttggaacttatgtttgttcagaaacttccttcctttgcagtttctggagaagaggtgccgctattaccaatctatgcccaagctgcaaatttacacttgttgctattaagagatgcatctacttttggaaaagagtggggtttttcaacttcagaaatttcaacattttataaacgtcaatctagtcgcacgagagaatattctgactactgttcagaatggtataatacgggactaaatcgcttaaaagggacaaatgccgcaagttgggtacggtataatcaattccgtagagatatgactttaatggtactagatctagtagcactattcccatgctatgatacacatatgtatcccattccaactagcgtccaacttacacgagaagtgtatacagatccaaacggtgcagtaggagtaaacaatactggttggtttcaaaatggggcttcgttttccgctatagaaaacgcaattattcgacaacctcacctatatgattttataacaaaccttacaatttacacgagaagaagtcaagtaggcactgcaattctgaatttgtgggcagggcataaaattaattttaatagaataggttctagtaatagtagcgaattggtgtatggagctagtactaacccggttagtactaatagcttatcatttgtcaatcaggatgtttttcgaactatatcattactcggcataaatggctctgtgagcggactaacttatggcttaactcgcgttgattttgatataagaaatcgtaactttactaatataatcagttcagtaacgtataattctgggcatcaaaatattggaacacaaacaagggattcagaaactgaattaccaccagaaacgacagaacagccaaattatgaagctaatagtcatctactaagccatatttcaatgtctccaacgactgcagcaacacctccagtatattcttggacacaccatagtgcagatcgtacgaatacaatcagttcggataggataacacaaataccattagtaaaggcacatacccttcaatcgggtaccactgtagtaaaagggccagggtttacaggaggggatatcctccgtcgaacaagtggaggaccatttgcttttagtaatgttaatctagattttaacttgtcacaaaggtatcgtgctagaattcgttatgcctctactactaacttgagaatttacataacggttgcaggcgaacgaattttagctggtcaatttaataaaactatggaaaaaggtgacccattaacgttccaatcttttagttacgcaactattaatacagcctttacattcccaacgagatcgagcagtttgactgtaggtgctgatacgttcgattcaggtaatgaagtgtatgtagatagatttgaattaatcccggatacttcaaaatttgaggcagagtccgatttagaaaaagcg

SEQ ID NO: 211 - DNA, 1884 bp, Bacillus thuringiensis
atgcctctatcgctagatgctcgtattgaggattctttgtgtatagccgaggggaatagtatcaatccacttgttagcgcctcaacagtccaaacgggtattaacatagctggtagaatactaggtgtattaggcgtaccgtttgctggacaactagctagtttttatagttttcttgtcggtgaattatggccccgcggcagagatcagtgggaaattttcttagaacatgtcgaacaacttataaatcaacaaataacagaaaatgctaggaatacggcacttgctcgattacaaggtttaggagattcctttagagcctatcaacagtcacttgaagattggctagaaaaccgtgatgatgcaagaacgagaagtgttctttatacccaatatatagctttagaacttgattttcttaatgcaatgccgcttttcgcaattagaaaccaagaagttccattattgatggtatatgctcaagctgcaaatttacacctattattattgagagatgcctctctttttggtagtaaatttgggcttacatcgcaggaaattcaacgctattatgagcgccaagtggaacgaacgagagattattccgactattgcgtagaatggtataatacaggtctaaatagcttgagagggacaaatgccgcaagttgggtacggtataatcaattccgtagagatctaacgttaggagtattagatctagtggcgctattcccaagctatgacactcgcacttatccaataaatacgagtgctcagttaacaagggaagtttatacagacgcaattgggactgtacatccgagtcaagcttttgcaagtacgacttggtataataataatgcaccttcgctctctgccatagaggctgcggttatccgaagcccgcatctacttgattttccagaacaacttacaatttacagcacattaagtcgatggagtaacactcagtatatgaatatatgggtaggtcatagacttgaatctcgaacaataggagggtcattaaatacctcgacacaaggatctaccaatacttctattaatcctgtaagattacagtttacggctcgagacgtttataggactgaatcattggcagggctaaatatatttttaactcaacctgttaatggggtaccttgggttagatttaattggagaaatcccctgaattctcttagaggtagccttctctatactatagggtatactggagttgggacgcaattacaagattcagaaactgaattaccaccagaaacaacagaacgaccaaattatgaatcttacagtcatagattatctcatataggactcatttcatcatctcatgtgagagcattggtatattcttggacgcaccgtagtgcagatcgtacaaatacaattggaccaaatagaattacacaaataccattggtaaaagcacttaaccttcattcaggtgctactgttgttagagggccaggatttacaggtggggatatccttcgtagaacgaatactggtacatttggagatatacgtttaaatattaatgtgccattatcccaaagatatcgcgtaaggattcgttatgcttctactacagatttacaatttttcacgagaattaatggaaccactgttaatattggtaatttctcaagaactatgaataggggggataatttagaatctagaagttttagagctgcaggatttagtactccttttaatttttcaaatgcccaaagcacattcacattgggtgctcagagtttttcaaatcaggaagtttatatagatagagtcgaatttgttccggcagaggtaaccttcgaagcagaatatgatttagaaagagcgcaagagtaa

SEQ ID NO: 212 - DNA, 1968 bp, Bacillus thuringiensis
atgccaccaaagaatcaaaataagtatcaaagtttatcgaaaaatgcgacagttgataaaatctctacggattcactaaaaaatgaaacagatagagaattgaaaaatatttataatgaagattgtttgagaatgtctgagcatgaaagtatggagccgtttgttagtgcatcaacaattcaaacggggattggtattgctggtaaaatccttggtaacctaggcgttccttttgctggacaagtagctagcctctatagttttatcctagatgagctttggcccaaagggaaaagccaatgggaaatctttatggaacatgtagaagagcttattgctcaaaaaatatcgacttacgccagaaacaaagcacttgcagatttaaaaggattaggggatgctttggctgtctaccatgagtcgctggaaagttggattaaaaatcgcaataacacaagagccagaagtgttgttaagaaccaatacatcgctttagaacttatgtttgtgcaagcgttgccttcttttgcagtgtctggagaggaagtaccactattaccaatatatgctcaagctgcaaatttacacttgttgctattaagagatgcgtctatttttggaaaagagtggggattatccgactcagaaatttccacattttataatcgccaatctggaaggtcgagggaatattctgaccactgcgtaaaatggtataatacaggcctaaatcgcttgaggggaacaaatgccgaaagttgggtacgttataatcaattccgcagagacatgactttaatggtactagatttagtcgcactattcccaagctatgatacacatatgtatccaattaaaactacagcccaacttacaagagaagtttatacaaatccaattggtgtcgtaggaggagtttcttggtttgaaaacgccgcttctttcgccgctatagaaaacgcagttattcgacaacctcatctatacgattttatgactgaccttaccatttacacgagactaagtcgagcactccctcgttatatgaatttgtgggcggggcatagaatcaattttaatacaattcgtggttctactagtcgcgaaatggtgtatggagctattactaatccagttagtactactcccctttcatttgtcaatcaagatatttatagaactcaatcaatagctggagtacttctcaatctttcaagcagattttacggcgtacctagagttgattttgatataagaaatcgtaactatcctaatataatcaatagactaacttataatcctggatacgcagaaattgcaactcaagtaaaagattcagaaactgaattaccgcctgaaacaacagaacagccaaattatgaagctgctagtcatctgctatgtcatattggaatgcctccaacggggtccggaactggttcagcaactcctccagtatattcttggacacaccggagtgcgggtcgtacgaatatcattaattcggatagtattacacaaatcccattagtaaaggctaataaccttcattcaggcgctactgtcgtcaagggcccaggatttacaggaggagacatactccgaagaactagcgcgggtacatttgtggatttaccagttaatcttattagttggcaattatcacaaagttatcgcgtaaggatacgttatgcttctactacggatttacaatttcatacgtcaattaacgggagagcaattaatcaggggaatttttcagcaactatgaatagaggagatgccttagaatctagaacctttagaactgtagggtttactactccttttaacttttcagatgcgcaaagtacattcacaataagtgcttggaacttctcttcaagtaacgaagtttatatagatagaattgaatttgttccagcagaagtaacattagaggcagaaagtttagaaagagcgcaaaaa

SEQ ID NO: 213 - DNA, 1977 bp, Bacillus thuringiensis
atgaattcttatcaaaataagaatgaatatgaaatactggatgcttcagaaaatactgtaaatgcgttaaacagatatcctttcgcaaataatccgtattcttccatttttagttcttgtccacgcagtgggcctggtaattggattaatatactaggaaatgcagttagcgaagcagtatctatttcgcaagatataatatctcttcttacacagccttctatctctgggataatttcaatggcatttagtcttttaagtagaatgataggtagtaatggaaggtctatatcggagttatctatgtgtgacttactagctattattgatttgcgggtaaatcagagtgttttggatgacggagttgctgattttaacggctcgttagttatatacagaaactatttagaggctttacaaaggtggaacaataatcccaatcccgctaatgccgaagaggttcgtactcgttttagggaatctgatacaatattcgatctcattttaacacaagggtctttaacgaatggcggttcattagccagaaataatgctcaaatattattattgccttcttttgcaaatgctgcatactttcatttactgctattaagagatgctaatgtatatgggaataattggggtttatttggggttacacctaatataaattatgaatcgaaattactaaaccttattagattatataccaattattgcacacattggtataatcaaggactaaatgaactaagaaatcgaggttccaatgctacagcttggttggaatttcatagatttcgtagagatatgacattgatggtattggatatagtatcatcattttcaagtcttgatattactagatatccaagagcaacagattttcaattgagtaggataatttatacagatccaattggttttgtaaatcgtagtgaccctagcgcaccaagaacctggtttagttttcacaatcaagctaatttttcagcgttagaaagtggaatacctagtccttcattctcacaattcttagatagtatgcgtatatctactggcccgcttagtttacctgcttctcctaatatccatagagcacgggtatggtatggtaatcaaaataactttaatggatctagtagccaaacttttggggaaataacaaatgataatcaaaccatttcgggtttaaatattttcagaatagattcacaggctgttaatctaaataatactacgtttggagttagtagagctgaattttatcatgatgctagtcaaggctctcaaagatccatatatcaaggatttgttgatacaggtggggctagtaccgctgtagcccagaatattcaaacatttttcccgggagaaaattcgagtataccaactccacaagattatactcatatattaagtaggtcaacaaatttaacaggaggacttcgacaagtagcatctggacgtcgttcttctttagtattacacggttggacacataaaagtctgagtcgtcaaaatagagttgaaccaaatagaattactcaagtgccggctgttaaagcaagttctccttcgaattgtactgtaattgcaggacctggatttacaggtggggatttagtcagaatgagttcaaactgtagcgtaagttacaattttacaccagctgatcagcaagttgtaatacgtctacgttatgcttgtcaagggacagcttcattaaggataacgtttggtaatggttctagccaaataattccgcttgtttctacaacttcatcaataaataatcttcaatatgaaaattttagttttgcttctggtccaaatagcgttaactttttatcagctggtacttcaataactattcaaaatatcagtacaaattctaacgtagtgctagatagaattgaaattgtgccagaacaacctattcctattattccaggggactatcaaattgtaacagct

SEQ ID NO: 214 - protein, 614 aa, Bacillus thuringiensis
MGRGSMEVNNQNQCVPYNCLNNPEIEILGGERISVGNTPIDISLSLTQFLLSEFVPGAGFVLGLIDLIWGFLGPSQWDAFLLQIEQLISQRIEEFARNQAISRLEGLSNLYRIYAEAFRAWEADPTNLALREEMRTQFNDMNSALVTAIPLFSVQNYQVPLLSVYVQAANLHLSVLRDVSVFGQRWGFDVATINSRYNDLTRLIGEYTDYAVRWYNTGLDRLRGSNFQDWIRYNRFRRELTLTVLDIVSVFQNYDSRLYPIQTSSQLTREIYSDLLLANPSGVGSFSNVDFDSILIRQPHLIDFMRVLTIYTDRHNASRHNIYWAGHQVTAVDTANRTIVYPVNGSAANLEPPRTLRFESPVVEIRSNPVWDRGSTGIAGSYEFFGVTSALFITILGFGYTYRSGSNTEVTALPDHQVSHIGYFRRFTTTGATARQTLTSAPIVSWTHSSAEPPNRIYQNRITQIPAVKGNFLFNGAVISGPGFTGGDLVRLNRNNDNIQNRGYIEVPIQFASTSTRYRVRVRYASTNAIEVNINWGNGSIFTGTAPATATSLDNLQSNDFGYFESTTAFAPSLGNIVGVRNFSANADVIIDRFEFIPVTATLEAEYDLERAEK

SEQ ID NO: 215 - protein, 679 aa, Bacillus thuringiensis
MPRNNQNDYEVIDASNCGCASGDVVKYPLTNDPNAGLQNINYKEYLQMSDENYTDSYINPSLSISGKSVIQVGINIVGRLLSFFGFPFANQVVAVYSYLLNTLWPNNDTEVWESFMAQVEELVDQKISEAVVGTALDHLSGLNYNYELYVEALEEWLERPNAARANLVFNRFTTLDSLFTQFMPSFGSGPGSNRYADSLLSVYAQAANLHLLFLKDADIYGARWGLNQTQIDQYHNRQQTLTRNYTNHCVTTFNDGLEKIRNTSAESWFKYNQYRREMTLMAMDLVALFPYYNVREYSMAVNPQLTREVYTDPIAFDPSEQPNTQLCRKWYTARFVQNNVNFSQLENAFIRSPHLFERLHSLEINFINGANWWWHKVRNQLLNNSLILERDYGTSTVNSPTTQLTVNTSNADIYQVRSRAENPTAAAGTYYSVRGVEFYLSSGVKREFSGTTVAPLACQELRNSIDELPSLEPNEPIIRNYSHRLSHITWYQFSGRQSGNPTTNNGDIPTYVWTHRDVDFNNTITPNRITQIPWIKASEIAANTTVVKGPGFTGGDILRSTIPGTVGTIRANVMAPLTQQYRIRLRYASTTNFVVNLFVNNSASGFTLPSTMVQNESLTYESFNTEEVTRTIRFSQSDTTLRLGIFSFDPGQEVYVDKLEIVPINPAREAEEDLEAAKK

SEQ ID NO: 216 - protein, 614 aa, Bacillus thuringiensis
MPNNIQNQCVPYNCLSTPEKILLDEERIETGNTSIDLSLSLVSLLLGEFVPGASFVLGLIDIIWGFAGPSQWDAFLVQIEQLIDERIGQFARNQAISRLEGLSNLYQIYAEDFTQWEADPDNPALREEMRTQFNDMNSALTTAIPLLAVQNYQIPLLSVYVQAANLHLSVLRDVSVFGQSWGFDAATINSRYNDLTRLISSYTDHVVRWYDTGLDRLRGSTYQDWFRYNRFRRELTLTALDIVALFPNYDIKMYPIQPVSQLTREVYTDPLINFNPQLQSVAQLPTFNVMESNAIRNPHLVDFLNNLRIFTDWFSVGRHYYWGGHRVISKRVGGREITFPIYGREAKQEPPRSFTFNGPVFRTLSNPTLRPLQQPAPAPPFNLRGLEGVKFYTPTNTFTYRGRGPRDSLTELPPGDTSVLPREGYSHRLCHATFIQRSGTPFLTTGVVFSWTHRSADETNIIYPDKITQIPWVKAHTLESGATVIKGPGFTGGDILTVLTSLGSLGALRVTFTGQLPQTYNIRIRYASVLNKYGTLHFSQPPAYGLTFPKTMDIDEPLTSRSFAFTTLWTPITFTRAQEEFNLTIQSGVYIDRIEFVPAEVTFEADYDLEKAQK

SEQ ID NO: 217 - protein, 617 aa, Bacillus thuringiensis
MDNNNQNQCIPYNCLSNPELEILEIERSNNTVVEDITLGLSRLLVSAIPLGDFILGLFDVIWGALGRSEWDIFLEQIELLIGQRIEEFARNQAISRLEGLSNLYRIYTNAFKDWEADPTNLELKEEMRTQFNDMNSAFTTAIPLFSVRGYELPLLSVYVQAANLHLSVLRDVSVFGQRWGFDVATVNRRYDDLTTNIGDYTDYALSWYNTGLNRLPRNDGLRGWARFNRFRRELTISVLDIISFFQNYDSRLYPIPTISQLTREVYTDPVINITDYRVTPSFESIENSAIRSPHLMDFLTNIIIDTDLIRGVYYWAGHRINSRFTGTAFPHIITSPQYGITANAEPRRTIVPGPFQGVPSLLYRTLSDPFFRRSDNISPTLGINVVQGVGFLQPNNFESLYRRRGTVDSLDELPIDGENPLVGYSHRLSHVTLTRSLFNTNITSLPTFVWTHHSATDTNTIAPDVITQIPLVKAFNLHSGATVARGPGFTGGDILRRTNVGNFGDMRVNITAPLSQRYRVRIRYASTTNLRFHTSINGRAINQADFPATMNSGGNLQSGSFRIAGFTTPFTFSDALSTFTIGAFGFSSGNEVYIDRIEFVPAEVTFEAEYDLERAQK

SEQ ID NO: 218 - protein, 667 aa, Bacillus thuringiensis
MEIINNQNQCIPYNCLNNPEVEILGIERSNSTVVEDISLGLSRLLVSAIPLGDFLLSLFDVIWGAIGRSEWDIFLEQIELLIGQRIEEFARNQAISRLEGLSNLYRIYTNAFKNWEADPTNPVLREEMRIQFNDMNSAFTTAIPLFSVQGYEIPLLGVEPHRYQANKIKYPLKIKKYAILSVESAERMAFFMSTSVSDELQLFAQEIQSLLSSNILRGFARDVGFVQRTSKYQAKDLVALCVWMNQNVATTSLTQLCSCLEASTEVLISPEGLNQRFNKAAVQFLQHILAELLNQKLASSMPISSPYTSIFKRIRILDSTAFQLPDVFSSVYPGAGGCSHTAGIKIQLEYDLLSGQFLHIHTGPGKQHDRTYGTLCAPTVTANDLCIRDLGYFHLKDLQYIQDKEAYYISRIKSNTRIYQKNPNPDYFQDGRIKKGTEYIQIDMETLMNSLQPGQTYEIADAYVGMIDKVPARVIVHRLTKQQQQKRLQDQAVREKKKGMKYSPRSKRLSGINVYMTNTPTDIVPMGQVHDWYSLRWQIEILFKTWKSFFHIHHCKKIKPERLECHLYGQLIAILLCSSIMFQMRQLLLIKKKRELSEYKAIYMIKDYFLLLFQTIQKNTQELSKVLLRLFNLLQQNGRKSHRYEKKTVFDILGVVYNCTMSDNQAA

SEQ ID NO: 219 - protein, 693 aa, Bacillus thuringiensis
MPRNNQNEYEVIDASTCGCPSDDVVKYPLTDDPNAGLQNMNYKEYLQMYGGDYTDPLINPNLPVSGKDVIQVGINIVGRLLSFFGFPFSSQWVAVYTHLLNSLWPDDENSVWDAFMKRVEELIDQKIAEAVHGLALDHLTGLQHNYNLYVEALDEWLNRPNGARAALVSQRFNNLDSLFTQFMPSFGSGPGSRNYATILLPVYAQAANLHLLLLKDVDIYGARWGLNQTQIDLFHSRQQGLTQTYTNHCVTAYNDGLAELRGTSVESWLKYHQYRREMTVTAMDLVALFPYYNVRQYPNGANPQLTREVYTDPIVFNPPKPPSGAFCESFYTIRAARERLTFSQLENAIIRPPRLFERFQALGIYTHEARLNQNSAPMNYWIGHFIRNTRLGDSTTITSNYGTTNNRLTNFTPPTNSDVYQINSISSNLAAILGTIFGVTNAAFHHGSGNIWSYVGQNNVLAQCHQNYNSIEELPNQSDEPTVRSYSHRLSHITSFNFNVQLNNPVLSTGNMPVYVWTHRGVDLNNTITSDRITQLPLVKASELVAGTTVVKGPGFTGGDILRRTSNGNFGTIRVMVSSPLTQQYRLRVRYASTGNFSIVVRRGSTTVGNIRVPSTMNRGAEFRYESFDTREFTTTGPQNPPFTFTQTQESLTVAAEGVSTGSEYFIDRIEIIPVNPTREAEEDLEAAKKAVA

SEQ ID NO: 220 - protein, 693 aa, Bacillus thuringiensis; identical to SEQ ID NO: 219

SEQ ID NO: 221 - protein, 708 aa, Bacillus thuringiensis
MNRNNQNEYEVIDAPHCGCPSEDVVKYPLTDDSNAGLQNMNYKEYLNMSEGDYADSIRYPLANNPYSSALNLNSCQNSSILNWINILGNAAKEAISIGTTIISIITTPSLTGLISITYDLISKVLGGSSGPSISDLSICDLLSIIDLRISQSVLNDGIADFNGSIIIYRNYLEALDSWNKNNTPAAAEEVRARFRAADTEFDRILTRGSLTNGGSLARQDGQILLLPSFASAAYFHLSLLRDAARYGANWGLFNATPLINYQSKLVELIESYTNYCVHWYNQGLNQLRQRGNSATAWLEFHRYRREMTLMVLDIVASFSSLDITRYPIETDFQLSRVIYTDPIGFVNRGNLRLESWFSSVNNATFSGLESAIPNPSQSWFLNSMIISTGSLTLPVSPNTDRARVWYGGRDRVSPASSQFITEQMSGQQTADTQNILGRNIFRIDSQACNLNNTTYGVNRALFYHDASQGSQRSLYEGFIRTTGIDNPVVQNINTYFPGENSDIPTPQDYTHILSRTINLTGGLRQVASGRRSSLVMYGWTHKSLTLNNTINPDRITQIPLTKLDSRGSNISYVNDPGFIGGNLLRMTANGTLGTLRANFPLNIRSHFRIRVRYAATRNIRLSVNGSFGTISQEFPSTMRLGEDLRYGSFAIREFSTSVRPTASPDVIRLTVEPIFSGQQIYVDRIEFVPVIPTREAEENLDAAKKAVA

SEQ ID NO: 222 - protein, 657 aa, Bacillus thuringiensis
MPSKNQNMYQSLSSNTTVDKNFTNSLENNTNMELQNINYEDCLRMSEYEGIEPFVSVSTIQTGIGIAGKILGTLGVPFAGQVASLYSFILGELWPKGKSQWEIFMEHVEEIINQKISTYARSKALTDLKGLGDALAVYHESLESWVGNRNNTRARSVVKSQYIALELMFVQKLPSFAVSGEEVTLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTIHPHPSFTSTTWYNNNAPSLSAIEAAVIRSPHLLDFPEQLTIYSTLSRWSNTQYMNIWVGHRLESRTIGGSLNTSTQGSTNTSINPVRLQFTARDVYRTESLAGLNIFLTQPVNGVPWVRFNWRNPLNSLRGSLLYTIGYTGVGTQLQDSETELPPETTERPNYESYSHRLSHIGLISSSHVRALVYSWTHRSADRTNTIGPNRITQIPLVKALNLHSGATVVRGPGFTGGDILRRTNTGTFGDIRLNINVPLSQRYRVRIRYASTTDLQFFTRINGTTVNIANFSRTMNRGDNLESRSFRTAGFSTPFNFSNAQSTFTLGAQSFSNQEVYIDRIEFVPVEVTYEAEYDFEKAQE

SEQ ID NO: 223 - protein, 661 aa, Bacillus thuringiensis
MPLKNQDKHQSFSSNAKVDKISTDSLKNETDIELQNINHEDCLKMSEYENVEPFVSASTIQTGIGIAGKILGTLGVPFAGQVASLYSFILGELWPKGKNQWEIFMEHVEEIINQKISTYARNKALTDLKGLGDALAVYHDSLESWVGNRNNTRARSVVKSQYIALELMFVQKLPSFAVSGEEVPLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAAIRSPHLLDFLEQLTIFSASSRWSNTRHMTYWRGHTIQSRPIGGGLNTSTHGATNTSINPVTLRFASRDVYRTESYAGVLLWGIYLEPIHGVPTVRFNFTNPQNISDRGTANYSQPYESPGLQLKDSETELPPETTERPNYESYSHRLSHIGIILQSRVNVPVYSWTHRSADRTNTIGPNRITQIPMVKASELPQGTTVVRGPGFTGGDILRRTNTGGFGPIRVTVNGPLTQRYRIGFRYASTVDFDFFVSRGGTTVNNFRFLRTMNSGDELKYGNFVRRAFTTPFTFTQIQDIIRTSIQGLSGNGEVYIDKIEIIPVTATFEAEYDLERAQE

SEQ ID NO: 224 - protein, 614 aa, Bacillus thuringiensis; identical to SEQ ID NO: 216

SEQ ID NO: 225 - protein, 615 aa, Bacillus thuringiensis
MPKVNNKNQCLPYNCLNNPENEILDIERSNSTVATNIALEISRLLASATPIGGILLGLFDAIWGSIGPSQWDLSLEQIELLIDQKIGEFARNQAISRLEEISSLYGIYTEAFREWEADPTNPALKEEMRTQFNDMNSILVTAIPLFSVQNYQVPFLSVYVQAANLHLSVLRDVSVFGQAWGFDIATINSRYNDLTRLIPIYTDYAVRWYNTGLDRLPRTGGLRNWARFNQFRRELTISVLDIISFFRNYDSRLYPIPTSSQLTREVYTDPVINITDYRVGPSFENIENSAIRSPHLMDFLNNLTIDTDLIRGVHYWAGHRVTSHFTGSSQVITTPQYGITANAEPRRTIAPSTFPGLNLFYRTLSNPFFRRSENITSTLGINVVQGVGFIQPNNAEVLYRSRGTVDSLNELPIDGENSLVGYSHRLSHVTLTRSLYNTNIISLPTFVWTHHSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELCIDKIELILADATFEEEYDLERAQK

SEQ ID NO: 226 - protein, 616 aa, Bacillus thuringiensis
MDNNNQNQCIPYNCLSNPELEILEIERSNNTVVEDITLGLSRLLVSAIPLGDFILGLFDVIWGALGRSEWDIFLEQIELLIGQRIEEFARNQAISRLEGLSNLYRIYTNAFKDWEADPTNLELKEEMRTQFNDMNSAFTTAIPLFSVRGYELPLLSVYVQAANLHLSVLRDVSVFGQRWGFDVATVNRRYDDLTTNIGDYTDYALSWYNTGLNRLPRNDGLRGWARFNRFRRELTISVLDIISFFQNYDSRLYPIPTISQLTREVYTDPVINITDYRVTPSFESIENSAIRSPHLMDFLTNIIIDTDLIRGVYYWAGHRINSRFTGTAFPHIITSPQYGITANAEPRRTIAPGPFQGAFPTYRTLSDPFFRRSDNISPTLGINVVQGVGFLQPNNFESLYRRRGTVDSLDELPIDGENPLVGYSHRLSHVTLTRSLFNTNITSLPTFVWTHHSATDTNTIAPDVITQIPLVKAFNLHSGATVARGPGFTGGDILRRTNVGNFGDMRVNITAPLSQRYRVRIRYASTTNLRFHTSINGRAINQADFPATMNSGGNLQSGSFRIAGFTTPFTFSDALSTFTIGAFGFSSGNEVYIDRIEFVPAEVTFEAEYDLERAQK

SEQ ID NO: 227 - protein, 682 aa, Bacillus thuringiensis
MPRNNQNEYEVIDAPHCGCPADDVVKYPLTDDPNAGLQNMNYKEYLQTYGGDYTDPLINPNLSVSGKDVIQVGINIVGRLLSFFGFPFSSQWVTVYTYLLNSLWPDDENSVWDAFMERVEELIDQKISEAVKGRALDDLTGLQYNYNLYVEALDEWLNRPNGARASLVSQRFNILDSLFTQFMPSFGSGPGSQNYATILLPVYAQAANLHLLLLKDADIYGARWGLNQTQIDQFHSRQQSLTQTYTNHCVTAYNDGLAELRGTSVASWLKYHQYRREMTVTAMDLVALFPYYNVRQYPNGANPQLTREVYTDPIVFNPPERPSGAFCESFYTIRAARERLTFSQLEHAIIRPPRLFERFQALGIYTGEARLNANSAPMNYWIGHFIRNTRLGDSTTITTNYGTTNNRLTNFSMPSDVYQINSTSSNLAAILGTLYGVTRAQFHFGSGSFSTYVGQNSVLPQCHQNYNSIEELPNQSDEPTVRSYSHRLSHITSFNFNVQLNNPLISAGNMPVYVWTHRSVDLTNRISSDRITQIPVVKAYELSSGATVVKGPGFTGGDVIRRTNTGGFGAIRVLVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEDAKK

SEQ ID NO: 228 - protein, 669 aa, Bacillus thuringiensis
MPRNNQNEYEIIDASTCGCSSDDVVQYPLARDPNAVFQNMHYKDYLQTYDGDYTGSLINPNLSINPRDVLQTGINIVGRLLGFLGVPFAGQLVTFYTFLLNQLWPTNDNAVWEAFMAQIEELINQRISEAVVGTAADHLTGLHDNYELYVEALEEWLERPNAARTNLLFNRFTTLDSLFTQFMPSFGTGPGSQNYAVPLLTVYAQAANLHLLLLKDAEIYGARWGLNQNQINSFHTRQQERTQYYTNHCVTTYNTGLDRLRGTNTESWLNYHRFRREMTLMAMDLVALFPYYNVRQYPNGANPQLTREIYTDPIVFNPPANVGLCRRWGNNPYNRFSELENAFIRPPHLFDRLNTLTISRNRFDVGSNFIEPWSGHTLRRSYSNNSTVYEDSYGQITATRTTINLPANGTGRVESTAVDFRSALVGIYGVNRASFIPGGVFSGTTQPSTGGCRDLYDSSDELPPDESTGSFAHRLSHVTFLSFTTNQAGSIANSGRVPTYVWTHRDVDFNNTINPNRITQIPVVKAYELSSGATVVKGPGFTGGDVIRRTNIGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKK

SEQ ID NO: 229 - protein, 614 aa, Bacillus thuringiensis
MPNRREFMNNETQNQCIPYNCLSNPEVEILGGDRSAGILPIQISLSLTRFLAGEFIPGVGVALGLFDLIWGFISPSDWDQFLVRIEQLIDQRIEELERTRALSALQGLANSYGVYVEALRAWEADPNNEALKEDVRTRFTSIDGDLIAEIPRFRLRGYEVPLLSVYVQATNLHLSMLRDSVSLGLRWGFDIATINNHYNRLINNIREYTDYSVSTYNIGLERLRGTRVQDWVKFNQFRRELTLTVLDIVSLFPNYDVRTYPIQTVSQLTREIYTNPVFENSPVNINLVNGFNRVEYGVRQPHLMDHLMNVSISEEDYRGDTFWGGHSIASVDTGGNLVGFPFYGNFDRFRFQTINAQQFPLFRTLSDPVYNLSTSGGRNRLFALEGIGFQQAVTGTTRAFRRVGTIDSLIEIPPQDESEVPWNGYSHVLNHITFINWPAVFLQGERIASPMFSWTHRSADRINRIIPDVINQIPAVKGSSIINGTVISGPGFTGGDLVRLENNAYLEIPVQFQTTSTNYRVRVRYASTSQASISVVFGNIDHPSTIPATAESLDNLQYNDFDYFDVIGTFLPSLGGSLAFRTLSSNANVVIDRFEFIPVTATFEAEYDLEKAQE

SEQ ID NO: 230 - protein, 621 aa, Bacillus thuringiensis
MPIMNNQNYCIPYNCLNNPALEILEEERISVGNTPIDISLSLTQFLLSEFVPGAGFVLGLFDLIWGFVGPSQWDAFLVQIEQLINQRIEEFARNQAISRLEGLSNLYRIYSEAFREWEADPTNPALREEMRIQFNDMNSALVTALPLFSVQNYQVPLLSVYVQAANLHLSVLRDVSVFGQRWGFDVATINSRYNDLTRNIGEYTDYAVRWYNTGLERVWGPDSRDWVRYNQFRRELTLTVLDIISLFPNYDSRTYPIRTVAQLTREIYTNPVLENFDGNFRGMAQRIEQNIRQPHLMDILNTITIYTDVHRGFNYWSGHQITASPVGFAGPEITFPRYGTMGNAAPPVLVSLIGLGIFRTLSSPLYRRLILGSGPNNQELFVLDGTEFSFASLTTNLPSTIYRQRGTVDSLDVIPPQDNSVPARAGFSHRLSHVTMLSQAAGAVYTLRAPTFSWQHRSAEFSNQIPSSQITQIPLTKSINLGSGTTVVKGPGFTGGDILRRTSSGEISTLRVTITAPLSQRYRVRIRYASTTNLQFNTVINGRSINQANFPATMDNGENLQFENFRTVGYTTPFSFSDASSIFTLTARNFSSGNEVYIDRIEFVPADATLEAEYDLERAQK

SEQ ID NO: 231 - protein, 656 aa, Bacillus thuringiensis
MPSNRKNENEIINALSIPAVSNHSAQMDLSLDARIEDSLCIAEGNNINPLVSASTVQTGINIAGRILGVLGVPFAGQLASFYSFLVGELWPSGRDPWEIFLEHVEQLIRQQVTENTRNTAIARLEGLGRGYRSYQQALETWLDNRNDARSRSIILERYVALELDITTAIPLFRIRNEEVPLLMVYAQAANLHLLLLRDASLFGSEWGMASSDVNQYYQEQIRYTEEYSNHCVQWYNTGLNNLRGTNAESWLRYNQFRRDLTLGVLDLVALFPSYDTRTYPINTSAQLTREIYTDPIGRTNAPSGFASTNWFNNNAPSFSAIEAAIFRPPHLLDFPEQLTIYSASSRWSSTQHMNYWVGHRLNFRPIGGTLNTSTQGLTNNTSINPVTLQFTSRDVYRTESNAGTNILFTTPVNGVPWARFNFINPQNIYERGATTYSQPYQGVGIQLFDSETELPPETTERPNYESYSHRLSHIGLIIGNTLRAPVYSWTHRSATNTNTINPDIITQIPLVKGFRLGGGTSVIKGPGFTGGDILRRNTIGEFVSLQVNINSPITQRYRLRFRYASSRDARITVAIGGQIRVDMTLEKTMEIGESLTSRTFSYTNFSNPFSFRANPDIIRIAEELPIRGGELYIDKIELILAEVTFEAEYDLERAQK

SEQ ID NO: 232 - protein, 549 aa, Bacillus thuringiensis
MPDTIILQTIAANIGSSLMPMGNPQNLYLYSYYGIKLIPFLGSILLLAVLGISLLFIFTQKLQKTDLKIELPVITVKNRKKATVWILILITIIASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTVHPHPSFTSTTWYNNNAPSFSAIEAAVVRNPHLLDFLEQVTIYSLLSRWSNTQYMNMWGGHKLEFRTIGGTLNISTQGSTNTSINPVTLPFTSRDVYRTESLAGLNLSLTQPVNGVPRVDFHWKFVTHPIASDNFYYPGYAGIGTQLQDSENELPPEATGQPNYESYSHRLSHIGLISASHVKALVYSWTHRSADRTNTIEPNSITQIPLVKAFNLSSGAAVVRGPGFTGGDILRRTNTGTLGDIRVNINPPFAQRYRVRIRYASTTDLQFHTSINGKAINQGNFSATMNRGEDLDYKTFRTVGFTTPFSFLDVQSTFTIGAWNFSSGNEVYIDRIEFVPVEVTYEAEYDFEKAQE

SEQ ID NO: 233 - protein, 651 aa, Bacillus thuringiensis
MPPNNQDNHETLSNKVTVEKPFTDSLKNETTKNSNYEDCLKMSRHESVEPFVSVSTIQTGIGIAGKILGSLGVPFAGQVASLYSFILGELWPKGKSQWEIFMEDVEKLVDQKISIYARNKALADLKGLGDALAVYHESLESWIENRNNRRARSVVKDQYIALELMFVQRLPSFAVSGEEVPLLPIYAQAANLHLLLLRDASIFGEEWGFSTSEISTFYNRQSSRTIEYSDYCSGWYNTGLNRLRGANAESWVRYNQFRRDMTLMVLDLVALFPSYDTRTYPIKTSAQLTREVYTDPNGIVAGGNNNWFRNGASFSTIENAIIRQPHLYDFLTNLTIYTRISRANPAYMNLWAGHRITSNRIGSSNSSELVYGAITNPVSTTNLSFVNRDVYRTESLAGGLGTLNGILYGLTRVDFDMIFRNRPDIVTGLFYHPGHAGIATQVKDSETELPPETTEQPNYRAFSHLLSHISMGPTTQDVPPVYSWTHQSADRSNTIDSDRITQIPLVKAHTLQSGTTVVKGPGFTGGDILRRTSGGPFAFSNVNLDFNLSQRYRARIRYASTTDLRIYVTVAGERIYAGKFNKTMKKGDPLTFQSFSYATINTAFTFPERSSSLTVGADTFDSGNEVYVDRFELIPDTVTFEAESDLEKAQK

SEQ ID NO: 234 - protein, 658 aa, Bacillus thuringiensis
MPLKNQDKHQSFSSNAKVDKIATDSLKNETDIELKNMNNEDYLRMSEHESIDPFVSASTIQTGIGIAGKILGTLGVPFAGQIASLYSFILGELWPKGKSQWEIFMEHVEELIAQKISTYARNKALTDLKGLGDALAVYHESLESWIKNRNNTRARSVVKSQYISLELMFVQKLPSFAVSGEEVPLLPIYAQAANLHLLLLRDASIFGKEWGLSSSEISTFYNRQAERTSDYSDHCVKWYSTGLNNLRGKNAESWVRYNQFRKDMILMVLDLVALFPSYDTHMYPIKTTAQLTREVYTNAIGTVHPHPSFASTTWYNNNAPSFSAIEAAVIRSPHLLDFLEQVTIYSLLSRWSNTQYMNMWGGHRLEFRTIGGALNTSTQGSTNTSINPVTLPFTSRDVYRTESLAGLNLFLTQPVNGVPRVDFHWKFVTHPIASDNFYYPGYAGIGTQLQDSETELPPETTGQPNYESYSHRLSHIGLISASHVKALVYSWTHRSADRTNTIEPNSITQIPLVKAFNLPSGAAVVRGPGFTGGDILRRTNTGTFGDIRVNINPPFAQRYRVRIRYASTTDVQFHTSINGKAINQGNFSATMNRGEDLDYKTFRTVGFTTPFSFSDVQSTFTIGAWNFSSGNEVYIDRIEFVPVEVTYEAEHDFEKAQE

SEQ ID NO: 235 - protein, 610 aa, Bacillus thuringiensis
MPSNEHDYLKVCDDLSETNMERFDKNDALEIGMSIVSELLGMIPGGAALQFVFNQLWSRLGDSGWSAFMEHVEELIDTKIEGYAKNKALSELAGMHRNLETYIKLLNEWENNTGSSKAQGRVANYFESLEQAVERGMPQFAVGNFEIPLLTVYVQAANLHLLLLRDVSVYGKRWGWSDQKIKIYYEKQVKYTHEYTNHCSTWYNRGLDKLKNKGSSYQDWYNYNRFRREITLTVLDIVAVFPHYDVKAYPIQTVGQLTREVYTDPLINFNPQLDSVSQLPTFSDMENATIRTPHLMEFLRMLTIYTDWYSVGRNYYWGGHRVTSYRVGGENITSPLYGSEANQELPRQLYFYGPVFRTLSNPTLRYLQQPAPAPPFALRRLEGVEFHTTTGTDMYRERGSVDSFNELPPFNPVGLPRNAYSHRLCHATFVRKSGTPYLITGTVFSWTHRSAEETNTIDSNRITQIPLVKAYQISSGTTVRRGPGFTGGDILRRTGPGTFGDIKLNINSPLSQRYRVRIRYASTTDLQFFTNINGTTINMGNFPKTVNNSSSEGYRTVSFSTPFSFSNAQSIFRLGIQAFSGVHEIHVDRIEFVPAEVTFEAEYDLERAQK

SEQ ID NO: 236 - protein, 622 aa, Bacillus thuringiensis
MAYNNNQNQCIPYNCLNNPEIEILEGGRISVGNTPIDISLSLTQFLLSEFVPGAGFVLGLIDLIWGFVGPSQWDAFLAQVEQLINQRIAEAVRNTAIQELEGMARVYRTYATAFAEWEKAPDDPELREALRTQFTATETYISGRISVLKIQTFEVQLLSVFAQAANLHLSLLRDVVFFGQRWGFSTTTVNNYYNDLTEGISTYTDYAVRWYNTGLERVWGPDSRDWVRYNQFRRELTLTVLDIVALFPNYDSRRYPIRTVSQLTREIYTNPVLENFDGSFRGSAQGIERSIRSPHLMDILNSITIYTDAHRGYYYWSGHQIMASPVGFSGPEFTFPLYGTMGNAAPQQRIVAQLGQGVYRTLSSTFYRRPFNIGINNQQLSVLDGTEFAYGTSSNLPSAVYRKSGTVDSLDEIPPQNNNVPPRQGFSHRLSHVSMFRSGSSSSVSIIRAPMFSWIHRSAEFNNIIASDSITQIPAVKGNFLFNGSVISGPGFTGGDLVRLNSSGNNIQNRGYIEVPIHFPSTSTRYRVRVRYASVTPIHLNVNWGNSSIFSNTVPATATSLDNLQSSDFGYFESANAFTSSLGNIVGVRNFSGTAGVIIDRFEFIPVTATLEAEYNLERAQK

SEQ ID NO: 237 - protein, 609 aa, Bacillus thuringiensis
MPRNNQNQCIPYNCLNNLESEILDIESLSSRSREQVAEISLGLTRFLLESLLPGASFGFGLFDIVWGVIGPDQWSLFLAQIEQLIDQRIETHVRNQAISRLEGLGDSYEVYIEALREWEASPNNESLQQDVRNRFSNTDNALINAIPILREQGFEIPLLTTYVQAANLHLSLLRDAVYFGQRWGLDTATVNNHYNRLINLINAYSDHCAQWFNRALNNFGVVSSRYLDFQREVTISVLDIVALFPNYDIRTYPIPTLSQLTREIYTSPVAEPGASLNVDLRNILREPHLMDFLTRLVIYTGVQSGIYHWAGHEISSRTTGNLSSNIQFPLYGIAASADRPVNLTIHYSETIYRTLSAPIYSISGGISPNRTRVVEGVRFLIARDNNMNSLPFLYRKEGSLDSFTELPPEDENAPPYIGYSHRLCHARFARSSVVAEPSNFARLPVFSWTHRSAGPTNEVSSSRITQIPWVKAHTLDSGASVIKGPGFTGGDILTRPNFGTLGALGVTFTGRLSQRYNIRIRYASVANRSGTFSYSLPPSYGISFPKTMDAGEPLTPRSFALTTLFTPITFSRAQEEFNLFIQQGVYIDRIEFVPVDETFEAEYDLERAQ

SEQ ID NO: 238 - protein, 719 aa, Bacillus thuringiensis
MPSKNQNMYQSLSSNTTVDKNFTNSLENNTNMELQNINYEDCLRMSEYEGIEPFVSVSTIQTGIGIAGKILGTLGVPFAGQVASLYSFILGELWPKGKSQWEIFMEHVEEIINQKISTYARSKALTDLKGLGDALAVYHESLESWVGNRNNTRARSVVKSQYIALELMFVQKLPSFAVSGEEVTLLPIYAQAANLHLLLLRDASIFGKEWGLSSSEISTFYNRQVERAGDYSDHCVKWYSTGLNNLRGTNAESWVRYNQFRRDMTLMVLDLVALFPSYDTQMYPIKTTAQLTREVYTDAIGTIHPHPSFTSTTWYNNNAPSFSAIEAAVVRNPHLLDFLEQVTIYSLLSRWSNTQYMNMWGGHKLEFRTIGGTLNTSTQGSTNTAINPVTLPFTSRDVYRTESLAGLNLFLTQPVNGVPRVDFHWKFVTHPIASDNFYYPGYAGIGTQLQDSENELPSEATGQPNYESYSHRLSHIGLISASHVKALVYSWTHRSADRTNTIEPNSITQIPLVKAFNLSSGAAVVRGPGFTGGDILRRTNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQEKVTALFTSTNPRGLKTDVKDYHIDQVSNLVESLSDEFYLDEKRELFEIVKYAKQIHIERNM

SEQ ID NO: 239 - protein, 684 aa, Bacillus thuringiensis
MGGKGMNRNNQNEYEVIYAATCGCPSDDVVKYPLASDPNASLQNINYKDYLKISEGDYIDSYINPGNVRTGLQTGIDIVALLVGTLGGPVGGILTGLLSTLFGFLWPSNDQAVWEAFIEQMEELIEQRISDQVVRTALDDLTGIQNYYNQYLLALEEWEEGPNSVRANLVLQRFENLHALFVSNMPSFGSGPGSQRFEAQLLIVYAQAANLHLLLLRDAEIYGARWGLRESQIELYFDELQNNTRDYTNHCVNAYNNGLEKVRGTNAASWLKYHQFRREATLTAMDLVALFPYYNLRQYPIAVNPQLTREVYTDPLGVPFEESNPFPEIRCSRWQETSAMTFSNLENAIVRPPHLFDIIRNLRIYTGTFRFNNNNLIEGWIGHSVTNNRLGISTEFTSNYGITTPIINSYNFANRDVYQINTRSNTSLIAFQNAPLFGITRAQFQPGGTYSVNQRTSLLCEQNYNSTDELPSLDPDEPISRSYSHRLSHITSYLHRVLTIDGINIYSGNLPTYVWTHRDVDLTNTITADRITHLPLIKSNVQRSGRPVKGPGFTGGDVLRISSSDADISIIGVSAGAPLTQQYRIRARYASNVDVTIRFIRHNTQSVIGSASLSSTMNSGEESRYEAYRTVEVISNFRLNSSSEQIRIVTQGLRANGQLYLDSLEFIPVNPTREAEEDLEAAKK

SEQ ID NO: 240 - protein, 649 aa, Bacillus thuringiensis
MKPNNQDNHETLSNKVTVEKPFTDSLKNETTKNSNYEDCLKMSRHESVEPFVSVSTIQTGIGIAGKILGSLGVPFAGQVASLYSFILGELWPKGKSQWEIFMEDVEKLVDQKISIYARNKALADLKGLGDALAVYHESLESWIENRNNRRARSVVKDQYIALELMFVQRLPSFAVSGEEVPLLPIYAQAANLHLLLLRDASIFGEEWGFSTSEISTFYNRQSSRTIEYSDYCSGWYNTGLNRLRGANAESWVRYNQFRRDMTLMVLDLVALFPSYDTRTYPIKTSAQLTREVYTDPNGIVAGGNNNWFRNGASFSTIENAIIRQPHLYDFLTNLTIYTRISRANPAYMNLWAGHRITSNRIGSSNSSELVYGAITNPVSTTNLSFVNRDVYRTESLAGGLGTLNGILYGLTRVDFDMIFRNRPDIVTGLFYHPGHAGIATQVKDSETELPPETTEQPNYRAFSHLLSHISMGPTTQDVPPVYSWTHQSADRSNTIDSDRITQIPLVKAHTLQSGTTVVKGPGFTGGDILRRTSGGPFAFSNVNLDFNLSQRYRARIRYASTTDLRIYVTVAGERIYAGKFNKTMKKGDPLTFQSFSYATINTAFTFPERSSSLTVGADTFDSGNEVYVDRFELIPDTVTFEAESDLEKA

SEQ ID NO: 241 - protein, 723 aa, Bacillus thuringiensis
MNRNNQNEYEVIDAPHCGCPADDVVKYPLTDDPNAGLQNMNYKEYLQTYGGDYTDPLINPNLSVSGKDVIQVGINIVGRLLSFFGFPFSSQWVTVYTYLLNSLWPDDENSVWDAFMERVEELIDQKISEAVKGRALDDLTGLQYNYNLYVEALDEWLNRPNGARASLVSQRFNILDSLFTQFMPSFGSGPGSQNYATILLPVYAQAANLHLLLLKDADIYGARWGLNQTQIDQFHSRQQSLTQTYTNHCVTAYNDGLAELRGTSVASWLKYHQYRREMTVTAMDLVALFPYYNVRQYPNGANPQLTREVYTDPIVFNPPERPSGAFCESFYTIRAARERLTFSQLEHAIIRPPRLFERFQALGIYTGEARLNANSAPMNYWIGHFIRNTRLGDSTTITTNYGTTNNRLTNFSMPSDVYQINSTSSNLAAILGTLYGVTRAQFHFGSGSFSTYVGQNSVLPQCHQNYNSIEELPNQSDEPTVRSYSHRLSHITSFNFNVQLNNPLISAGNMPVYVWTHRSVDLTNRISSDRITQIPVVKAYELSSGATVVKGPGFTGGDVIRRTNTGGFGAIRVLVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKKAVASLFTRTRDGLQVNVTDYQVDQAANLVSCLSDEQYGHDK

SEQ ID NO: 242 - protein, 771 aa, Bacillus thuringiensis
MNRNNQNDYEVIDASNCGCASGDVVKYPLTNDPNAGLQNINYKEYLQMSDENYTDSYINPSLSISGKSVIQVGINIVGRLLSFFGFPFANQVVAVYSYLLNTLWPNNDTEVWESFMAQVEELVDQKISEAVVGTALDHLSGLNYNYELYVEALEEWLERPNAARANLVFNRFTTLDSLFTQFMPSFGSGPGSNRYADSLLSVYAQAANLHLLFLKDADIYGARWGLNQTQIDQYHNRQQTLTRNYTNHCVTTFNDGLEKIRNTSAESWFKYNQYRREMTLMAMDLVALFPYYNVREYSMAVNPQLTREVYTDPIAFDPSEQPNTQLCRKWYTARFVQNNVNFSQLENAFIRSPHLFERLHSLEINFINGANWWWHKVRNQLLNNSLILERDYGTSTVNSPTTQLTVNTSNADIYQVRSRAENPTAAAGTYYSVRGVEFYLSSGVKREFSGTTVAPLACQELRNSIDELPSLEPNEPIIRNYSHRLSHITWYQFSGRQSGNPTTNNGDIPTYVWTHRDVDFNNTITPNRITQIPWIKASEIAANTTVVKGPGFTGGDILRSTIPGTVGTIRANVMAPLTQQYRIRLRYASTTNFVVNLFVNNSASGFTLPSTMVQNESLTYESFNTEEVTRTIRFSQSDTTLRLGIFSFDPGQEVYVDKLEIVPINPAREAEEDLEAAKKAVASLFTRTRDGLQVNVTDYQVDQAANLVSCLSDEQYGHDKKMLLEAVRAAKRLSRERNLLQDPDFNEINSTEENGWKASSGVTISEGGPFF

SEQ ID NO: 243 - protein, 652 aa, Bacillus thuringiensis
MKPNNQNNHQTLSSNMTVNKTSTDSLKNETTMELKNSNYKDCLKMSEHESIEPFVSVSTIQTGIGIAGKILGSLGVPFSGQVASLYSFILGELWPKGKSQWEIFMEHVEELVAQKISTYARNKALADLKGLGDALAVYHESLESWIKDRNNTRVRSVVKNQYINLELMFVQKLPSFAVSGEEVPLLPIYAQAANLHLLLLRDASTFGKEWGFSTSEISTFYKRQSSRTREYSDYCSEWYNTGLNRLKGTNAASWVRYNQFRRDMTLMVLDLVALFPCYDTHMYPIPTSVQLTREVYTDPNGAVGVNNTGWFQNGASFSAIENAIIRQPHLYDFITNLTIYTRRSQVGTAILNLWAGHKINFNRIGSSNSSELVYGASTNPVSTNSLSFVNQDVFRTISLLGINGSVSGLTYGLTRVDFDIRNRNFTNIISSVTYNSGHQNIGTQTRDSETELPPETTEQPNYEANSHLLSHISMSPTTAATPPVYSWTHHSADRTNTISSDRITQIPLVKAHTLQSGTTVVKGPGFTGGDILRRTSGGPFAFSNVNLDFNLSQRYRARIRYASTTNLRIYITVAGERILAGQFNKTMEKGDPLTFQSFSYATINTAFTFPTRSSSLTVGADTFDSGNEVYVDRFELIPDTSKFEAESDLEKA

SEQ ID NO: 244 - protein, 627 aa, Bacillus thuringiensis
MDLSLDARIEDSLCIAEGNSINPLVSASTVQTGINIAGRILGVLGVPFAGQLASFYSFLVGELWPRGRDQWEIFLEHVEQLINQQITENARNTALARLQGLGDSFRAYQQSLEDWLENRDDARTRSVLYTQYIALELDFLNAMPLFAIRNQEVPLLMVYAQAANLHLLLLRDASLFGSKFGLTSQEIQRYYERQVERTRDYSDYCVEWYNTGLNSLRGTNAASWVRYNQFRRDLTLGVLDLVALFPSYDTRTYPINTSAQLTREVYTDAIGTVHPSQAFASTTWYNNNAPSLSAIEAAVIRSPHLLDFPEQLTIYSTLSRWSNTQYMNIWVGHRLESRTIGGSLNTSTQGSTNTSINPVRLQFTARDVYRTESLAGLNIFLTQPVNGVPWVRFNWRNPLNSLRGSLLYTIGYTGVGTQLQDSETELPPETTERPNYESYSHRLSHIGLISSSHVRALVYSWTHRSADRTNTIGPNRITQIPLVKALNLHSGATVVRGPGFTGGDILRRTNTGTFGDIRLNINVPLSQRYRVRIRYASTTDLQFFTRINGTTVNIGNFSRTMNRGDNLESRSFRAAGFSTPFNFSNAQSTFTLGAQSFSNQEVYIDRVEFVPAEVTFEAEYDLERAQE

SEQ ID NO: 245 - protein, 656 aa, Bacillus thuringiensis
MPPKNQNKYQSLSKNATVDKISTDSLKNETDRELKNIYNEDCLRMSEHESMEPFVSASTIQTGIGIAGKILGNLGVPFAGQVASLYSFILDELWPKGKSQWEIFMEHVEELIAQKISTYARNKALADLKGLGDALAVYHESLESWIKNRNNTRARSVVKNQYIALELMFVQALPSFAVSGEEVPLLPIYAQAANLHLLLLRDASIFGKEWGLSDSEISTFYNRQSGRSREYSDHCVKWYNTGLNRLRGTNAESWVRYNQFRRDMTLMVLDLVALFPSYDTHMYPIKTTAQLTREVYTNPIGVVGGVSWFENAASFAAIENAVIRQPHLYDFMTDLTIYTRLSRALPRYMNLWAGHRINFNTIRGSTSREMVYGAITNPVSTTPLSFVNQDIYRTQSIAGVLLNLSSRFYGVPRVDFDIRNRNYPNIINRLTYNPGYAEIATQVKDSETELPPETTEQPNYEAASHLLCHIGMPPTGSGTGSATPPVYSWTHRSAGRTNIINSDSITQIPLVKANNLHSGATVVKGPGFTGGDILRRTSAGTFVDLPVNLISWQLSQSYRVRIRYASTTDLQFHTSINGRAINQGNFSATMNRGDALESRTFRTVGFTTPFNFSDAQSTFTISAWNFSSSNEVYIDRIEFVPAEVTLEAESLERAQK

SEQ ID NO: 246 - protein, 659 aa, Bacillus thuringiensis
MPSYQNKNEYEILDASENTVNALNRYPFANNPYSSIFSSCPRSGPGNWINILGNAVSEAVSISQDIISLLTQPSISGIISMAFSLLSRMIGSNGRSISELSMCDLLAIIDLRVNQSVLDDGVADFNGSLVIYRNYLEALQRWNNNPNPANAEEVRTRFRESDTIFDLILTQGSLTNGGSLARNNAQILLLPSFANAAYFHLLLLRDANVYGNNWGLFGVTPNINYESKLLNLIRLYTNYCTHWYNQGLNELRNRGSNATAWLEFHRFRRDMTLMVLDIVSSFSSLDITRYPRATDFQLSRIIYTDPIGFVNRSDPSAPRTWFSFHNQANFSALESGIPSPSFSQFLDSMRISTGPLSLPASPNIHRARVWYGNQNNFNGSSSQTFGEITNDNQTISGLNIFRIDSQAVNLNNTTFGVSRAEFYHDASQGSQRSIYQGFVDTGGASTAVAQNIQTFFPGENSSIPTPQDYTHILSRSTNLTGGLRQVASGRRSSLVLHGWTHKSLSRQNRVEPNRITQVPAVKASSPSNCTVIAGPGFTGGDLVRMSSNCSVSYNFTPADQQVVIRLRYACQGTASLRITFGNGSSQIIPLVSTTSSINNLQYENFSFASGPNSVNFLSAGTSITIQNISTNSNVVLDRIEIVPEQPIPIIPGDLEAAKK

SEQ ID NO: 247 - protein, 5 aa, Bacillus thuringiensis
QIEQL

SEQ ID NO: 248 - protein, 5 aa, Bacillus thuringiensis
  misc_feature (3)..(3): Xaa can be any naturally occurring amino acid
DPXNP

SEQ ID NO: 249 - protein, 5 aa, Bacillus thuringiensis
SLQPG

SEQ ID NO: 250 - protein, 5 aa, Bacillus thuringiensis
ANLHL

SEQ ID NO: 251 - protein, 5 aa, Bacillus thuringiensis
WTHRS

SEQ ID NO: 252 - protein, 5 aa, Bacillus thuringiensis
ITQIP

SEQ ID NO: 253 - protein, 5 aa, Bacillus thuringiensis
GFTGG

SEQ ID NO: 254 - protein, 5 aa, Bacillus thuringiensis
RYASS

SEQ ID NO: 255 - protein, 5 aa, Bacillus thuringiensis
KTMEI

SEQ ID NO: 256 - protein, 5 aa, Bacillus thuringiensis
TFRYT

SEQ ID NO: 257 - protein, 5 aa, Bacillus thuringiensis
PFSFR

SEQ ID NO: 258 - protein, 5 aa, Bacillus thuringiensis
GQRWG

SEQ ID NO: 259 - protein, 189 aa, Bacillus thuringiensis
SHRLSHIGLISASHVKALVYSWTHRSADRTNTIEPNSITQIPLVKAFNLSSGAAVVRGPGFTGGDILRRKNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQE

SEQ ID NO: 260 - protein, 192 aa, Bacillus thuringiensis
SHRLCHATFVQRSGTPFLTTGPVFSWTHRSATDRNIIYPDVINQIPLVKAFNLTSGTSVVRGPGFTGGDIIRTNVNGSVLSMSLNFSNTTLQRYRVRVRYAASQTMVMSVTVGGSTTGNQGFPSTMSANGALTSQSFRFAEFPVGISASGSQGASISISNNVGRQMFHLDRIEFLPVTSTFEEEYDLERAQE

SEQ ID NO: 261 - protein, 196 aa, Bacillus thuringiensis
SHVLNHVTFVRWPGEISGSDSWRAPMFSWTHRSATPTNTIDPERITQIPLVKAHTLQSGTTVVRGPGFTGGDILRRTSGGPFAYTIVNINGQLPQRYRARIRYASTTNLRIYVTVAGERIFAGQFNKTMDTGDPLTFQSFSYATINTAFTFPMSQSSFTVGADTFSSGNEVYIDRFELIPVTATFEAEYDLERAQK

SEQ ID NO: 262 - protein, 198 aa, Bacillus thuringiensis
FNLLSHVTFLRFNTTQGGPLATVGFVPTYVWTRQDVDFNNIITPNRITQIPVVKAYELSSGATVVKGPGFTGGDVIRRTNTGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKK

SEQ ID NO: 263 - protein, 196 aa, Bacillus thuringiensis
SHRLSHVSMFRSGFSNSSVSIIRAPMFSWIHRSAEFNNIIPSSQITQIPLTKSTNLGSGTSVVKGPGFTGGDILRRTSPGQISTLRVNITAPLSQRYRVRIRYASTTNLQFHTSIDGRPINQGNFSATMSSGGNLQSGSFRTVGFTTPFNFSNGSSVFTLSAHVFNSGNEVYIDRIEFVPAEVTFEAEYDLERAQE

SEQ ID NO: 264 - protein, 188 aa, Bacillus thuringiensis
SHRLSHIGLIIGNTLRAPVYSWTHRSADRTNTIGPNRITQIPLVKALNLHSGVTVVGGPGFTGGDILRRTNTGTFGDIRLNINVPLSQRYRVRIRYASTTDLQFFTRINGTTVNIGNFSRTMNRGDNLEYRSFRTAGFSTPFNFLNAQSTFTLGAQSFSNQEVYIDRVEFVPAEVTFEAEYDLERAQK

SEQ ID NO: 265 - protein, 205 aa, Bacillus thuringiensis
SHRLCHATFVQRSGTPFLTTGVVFSWTDRSATLTNTIDPERINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQE

SEQ ID NO: 266 - protein, 5 aa, Bacillus thuringiensis
QLTRE

SEQ ID NO: 267 - protein, 5 aa, Bacillus thuringiensis
SHRLS

SEQ ID NO: 268 - protein, 187 aa, Bacillus thuringiensis
SHRLCHATFLERISGPRIAGTVFSWTHRSASPTNEVSPSRITQIPWVKAHTLASGASVIKGPGFTGGDILTRNSMGELGTLRVTFTGRLPQSYYIRFRYASVANRSGTFRYSQPPSYGISFPKTMDAGEPLTSRSFAHTTLFTPITFSRAQEEFDLYIQSGVYIDRIEFIPVTATFEAEYDLERAQK

SEQ ID NO: 269 - protein, 167 aa, Bacillus thuringiensis
WTHRSATTTNTINPNAIIQIPLVKAFNLHSGATVVRGPGFTGGDILRRTNTGTFADMRVNITGPLSQRYRVRIRYASTTDLQFFTRINGTSVNQGNFQRTMNRGDNLESGNFRTAGFSTPFSFSNAQSTFTLGTQAFSNQEVYIDRIEFVPAEVTFEAESDLERAQK

SEQ ID NO: 270 - protein, 168 aa, Bacillus thuringiensis
WTHRSADRTNTIEPNSITQIPLVKAFNLSSGAAVVRGPGFTGGDILRRKNTGTFGDIRVNINPPFAQRYRVRIRYASTTDLQFHTSINGKAINQGNFSATMNRGEDLDYKTFRTVGFTTPFSFSDVQSTFTIGAWNFSSGNEVYIDRIEFVPVEVTYEAEYDFEKAQE

SEQ ID NO: 271 - DNA, 2010 bp, Unknown
  Artificial Sequence
atgcctcgaaataatcaaaatgaatatgaaattattgacgcttccacttgtggttgttcgtcagatgatgttgttcaataccctttggcaagagatccgaatgctgtattccaaaatatgcattataaagattatttgcaaacgtatgatggagactatacaggttctcttataaatcctaacttatctattaatcctagagatgtactgcaaactggaattaatattgtgggaagattactaggatttctaggtgttccatttgctggtcagttagttactttctatacctttcttttaaatcaactgtggccaacaaatgataatgcagtatgggaagcttttatggcacaaatagaagagcttattaatcaaagaatatccgaagcagtagtagggacagcagcggatcatttaacgggattacacgataattatgagttatatgtagaggcattggaggaatggctggaaagaccgaatgctgctagaactaatctactttttaatagatttaccaccctagatagtctttttacacaatttatgccaagctttggtactggacctggaagtcaaaactacgcagttccattacttacagtatacgcacaagcagcgaaccttcatttgttattattaaaggatgctgaaatatatggagcaagatggggactgaaccaaaatcagattaactcattccatacgcgccaacaagaacgtactcaatattatacaaatcattgcgtaacgacgtataataccggtttagatagattaagaggcacaaatactgaaagttggttaaattatcatcgtttccgtagagagatgacattaatggcaatggatttagtagcgctattcccatattataatgtacgacaatatccaaatggagcaaatcctcagctgacccgtgaagtttacactgacccgatcgttttcaacccgccggctaacgttggcctgtgccgccgttggggcaccaacccgtataacacgttctccgaactggaaaacgcttttatccgtccaccgcacctgttcgatcgcctgaactccctgacgatttcctctaaccgttttccggtgtcttctaactttatggactattggtccggtcacacgctgcgccgctcttacctgaatgactccgccgttcaagaggattcttatggtctgatcaccaccactcgtgcgaccatcaacccaggcgtggatggcaccaaccgtattgaaagcactgcagttgacttccgtagcgcactgatcggcatctacggtgttaatcgtgcatcttttgttccgggcggtctgtttaacggtaccacctccccggcaaacggcggctgccgtgacctgtatgatacgaacgatgagctgccgccggatgagtccactggctcttccactcaccgtctgtcccacgtaacttttttcagcttccagaccaatcaagcaggttctattgcaaacgccggctccgttccgacctatgtgtggacccgccgtgatgttgatctgaataacaccattacgccgaaccgtatcaatcaaattccggtggtaaaggcatatgagctaagtagtggtgctactgtcgtgaaaggtccaggattcacaggaggagatgtaatccgaagaacaaatattggtgggttcggagcaataagggtgtcggtcactggaccgctaacacaacgatatcgcataaggttccgttatgcttcgacaatagattttgatttctttgtaacacgtggaggaactactataaataattttagatttacacgtacaatgaacaggggacaggaatcaagatatgaatcctatcgtactgtggagtttacaactccttttaactttacacaaagtcaagatataattcgaacatctatccagggacttagtggaaatggggaagtataccttgatagaattgaaatcatccctgtaaatccaacacgagaagcggaagaggatctagaagcagcaaagaaataa

SEQ ID NO: 272 - DNA, 2001 bp, Unknown
  Artificial Sequence
atgcctcgaaataatcaaaatgaatatgaaattattgacgcttccacttgtggttgttcgtcagatgatgttgttcaataccctttggcaagagatccgaatgctgtattccaaaatatgcattataaagattatttgcaaacgtatgatggagactatacaggttctcttataaatcctaacttatctattaatcctagagatgtactgcaaactggaattaatattgtgggaagattactaggatttctaggtgttccatttgctggtcagttagttactttctatacctttcttttaaatcaactgtggccaacaaatgataatgcagtatgggaagcttttatggcacaaatagaagagcttattaatcaaagaatatccgaagcagtagtagggacagcagcggatcatttaacgggattacacgataattatgagttatatgtagaggcattggaggaatggctggaaagaccgaatgctgctagaactaatctactttttaatagatttaccaccctagatagtctttttacacaatttatgccaagctttggtactggacctggaagtcaaaactacgcagttccattacttacagtatacgcacaagcagcgaaccttcatttgttattattaaaggatgctgaaatatatggagcaagatggggactgaaccaaaatcagattaactcattccatacgcgccaacaagaacgtactcaatattatacaaatcattgcgtaacgacgtataataccggtttagatagattaagaggcacaaatactgaaagttggttaaattatcatcgtttccgtagagagatgacattaatggcaatggatttagtagcgctattcccatattataatgtacgacaatatccaaatggagcaaatcctcagctgacccgtgaaatctacactgacccgatcgtttataacccgccggctaaccaaggcatctgccgccgttggggcaacaacccgtataacacgttctccgaactggaaaacgcttttatccgtccaccgcacctgttcgaacgcctgaaccgcctgacgatttcccgcaaccgttacactgcgccgaccactaacagcttcctggactattggtctggtcatacgctgcagagccagcacgcgaataacccgactacttacgagacgtcttatggtcagatcacttctaacacccgtctgttcaatacgaccaacggcgctcgtgcgattgatagccgtgcccgcaacttcggtaacctgtacgccaacctgtacggtgttagctctctgaacatcttcccgaccggtgttatgtccgaaatcaccaacgcagcgaacacctgccgtcaggacctgaccacgaccgaagagctgccgctggagaacaacaacttcaacctgctgtcccacgtaactttcctgcgtttcaacaccacccagggtggcccgctggctaccctgggcttcgtgcctacttacgtttggacccgtgaagacgtagactttaccaataccattactgcagatcgcatcaatcaaattccggtggtaaaggcatatgagctaagtagtggtgctactgtcgtgaaaggtccaggattcacaggaggagatgtaatccgaagaacaaatattggtgggttcggagcaataagggtgtcggtcactggaccgctaacacaacgatatcgcataaggttccgttatgcttcgacaatagattttgatttctttgtaacacgtggaggaactactataaataattttagatttacacgtacaatgaacaggggacaggaatcaagatatgaatcctatcgtactgtggagtttacaactccttttaactttacacaaagtcaagatataattcgaacatctatccagggacttagtggaaatggggaagtataccttgatagaattgaaatcatccctgtaaatccaacacgagaagcggaagaggatctagaagcagcaaagaaataa

SEQ ID NO: 273 - DNA, 2034 bp, Unknown
  Artificial Sequence
atgcctcgaaataatcaaaatgaatatgaaattattgacgcttccacttgtggttgttcgtcagatgatgttgttcaataccctttggcaagagatccgaatgctgtattccaaaatatgcattataaagattatttgcaaacgtatgatggagactatacaggttctcttataaatcctaacttatctattaatcctagagatgtactgcaaactggaattaatattgtgggaagattactaggatttctaggtgttccatttgctggtcagttagttactttctatacctttcttttaaatcaactgtggccaacaaatgataatgcagtatgggaagcttttatggcacaaatagaagagcttattaatcaaagaatatccgaagcagtagtagggacagcagcggatcatttaacgggattacacgataattatgagttatatgtagaggcattggaggaatggctggaaagaccgaatgctgctagaactaatctactttttaatagatttaccaccctagatagtctttttacacaatttatgccaagctttggtactggacctggaagtcaaaactacgcagttccattacttacagtatacgcacaagcagcgaaccttcatttgttattattaaaggatgctgaaatatatggagcaagatggggactgaaccaaaatcagattaactcattccatacgcgccaacaagaacgtactcaatattatacaaatcattgcgtaacgacgtataataccggtttagatagattaagaggcacaaatactgaaagttggttaaattatcatcgtttccgtagagagatgacattaatggcaatggatttagtagcgctattcccatattataatgtacgacaatatccaaatggagcaaatcctcagctgacccgtgaaatttatacagatccaattggttttgtaaatcgtggtacttcaagtagattaagctggtttgattggcaaaatagagctaatttttcagaattagaaagggcaataccagatcccgtactttcgcaatttttaaatagtattcgtatatatactggtatactgtcattacctgtttctccaaataccgttagaggacgggtatggtatgggaatcaaaatcaggttagtagtgctaattcacaagatgttttcaatcagactttcggccaagtaacaaatgatagacaaaacctttcaggattaaatatatttagggttgattcgcaagcagctaatctaaataattctttgtatggtgtaagtagagctgaatttttccacgatgctagccaagggtctagaaggtccgtatatcaagggtatattagaactagcgggctagataaccctgtaacgcagactattcgaacttttttaccaggagagaattcggatacaccaactccagaagattatactcatgtattaagtgctgcaataaatttaactggcggccttcgacaaccagtaactaatcgtcgttcttctgtggtgatgtatggatggacacataggagcctaagtcgtgaaaatacaatattttcagatagaatcaatcaaattccggtggtaaaggcatatgagctaagtagtggtgctactgtcgtgaaaggtccaggattcacaggaggagatgtaatccgaagaacaaatattggtgggttcggagcaataagggtgtcggtcactggaccgctaacacaacgatatcgcataaggttccgttatgcttcgacaatagattttgatttctttgtaacacgtggaggaactactataaataattttagatttacacgtacaatgaacaggggacaggaatcaagatatgaatcctatcgtactgtggagtttacaactccttttaactttacacaaagtcaagatataattcgaacatctatccagggacttagtggaaatggggaagtataccttgatagaattgaaatcatccctgtaaatccaacacgagaagcggaagaggatctagaagcagcaaagaaataa

SEQ ID NO: 274 - DNA, 2043 bp, Unknown
  Artificial Sequence
atgcctcgaaataatcaaaatgaatatgaaattattgacgcttccacttgtggttgttcgtcagatgatgttgttcaataccctttggcaagagatccgaatgctgtattccaaaatatgcattataaagattatttgcaaacgtatgatggagactatacaggttctcttataaatcctaacttatctattaatcctagagatgtactgcaaactggaattaatattgtgggaagattactaggatttctaggtgttccatttgctggtcagttagttactttctatacctttcttttaaatcaactgtggccaacaaatgataatgcagtatgggaagcttttatggcacaaatagaagagcttattaatcaaagaatatccgaagcagtagtagggacagcagcggatcatttaacgggattacacgataattatgagttatatgtagaggcattggaggaatggctggaaagaccgaatgctgctagaactaatctactttttaatagatttaccaccctagatagtctttttacacaatttatgccaagctttggtactggacctggaagtcaaaactacgcagttccattacttacagtatacgcacaagcagcgaaccttcatttgttattattaaaggatgctgaaatatatggagcaagatggggactgaaccaaaatcagattaactcattccatacgcgccaacaagaacgtactcaatattatacaaatcattgcgtaacgacgtataataccggtttagatagattaagaggcacaaatactgaaagttggttaaattatcatcgtttccgtagagagatgacattaatggcaatggatttagtagcgctattcccatattataatgtacgacaatatccaaatggagcaaatcctcagctgacccgtgaagtttacactgacccgatcgttttcaacccgccggctaacgttggcctgtgccgccgttggggcaccaacccgtataacacgttctccgaactggaaaacgcttttatccgtccaccgcacctgttcgatcgcctgaactccctgacgatttcctctaaccgttttccggtgtcttctaactttatggactattggtccggtcacacgctgcgccgctcttacctgaatgactccgccgttcaagaggattcttatggtctgatcaccaccactcgtgcgaccatcaacccaggcgtggatggcaccaaccgtattgaaagcactgcagttgacttccgtagcgcactgatcggcatctacggtgttaatcgtgcatcttttgttccgggcggtctgtttaacggtaccacctccccggcaaacggcggctgccgtgacctgtatgatacgaacgatgagctgccgccggatgagtccactggctcttccactcaccgtctgtcccacgtaacttttttcagcttccagaccaatcaagcaggttctattgcaaacgccggctccgttccgacctatgtgtggacccgccgtgatgttgatctgaataacaccattacgccgaaccgtatcaatcaaattccgctggtgaagggctttcgtgtttggggcggcacttccgtaatcactggtccgggtttcacgggtggcgatattctgcgtcgcaacacgttcggcgacttcgtttccctgcaggtaaacatcaactctccgatcacccagcgctaccgcctgcgcttccgttacgcctcttctcgtgatgcacgtgttatcgtcctgaccggcgcagcaagcaccggcgttggtggtcaagtttctgtgaacatgccactgcagaaaaccatggaaatcggcgaaaacctgacgtcccgcactttccgctataccgattttagcaatccgttctcctttcgtgcaaacccggacatcattggcatctctgagcaaccgctgttcggtgctggttccatctcctctggtgagctgtatatcgacaagatcgaaattatcctggcggacgctaccttcgaagcggagagcgacctggaacgcgcgcagtaa

SEQ ID NO: 275 - protein, 669 aa, Unknown
  Artificial Sequenec
MPRNNQNEYEIIDASTCGCSSDDVVQYPLARDPNAVFQNMHYKDYLQTYDGDYTGSLINPNLSINPRDVLQTGINIVGRLLGFLGVPFAGQLVTFYTFLLNQLWPTNDNAVWEAFMAQIEELINQRISEAVVGTAADHLTGLHDNYELYVEALEEWLERPNAARTNLLFNRFTTLDSLFTQFMPSFGTGPGSQNYAVPLLTVYAQAANLHLLLLKDAEIYGARWGLNQNQINSFHTRQQERTQYYTNHCVTTYNTGLDRLRGTNTESWLNYHRFRREMTLMAMDLVALFPYYNVRQYPNGANPQLTREVYTDPIVFNPPANVGLCRRWGTNPYNTFSELENAFIRPPHLFDRLNSLTISSNRFPVSSNFMDYWSGHTLRRSYLNDSAVQEDSYGLITTTRATINPGVDGTNRIESTAVDFRSALIGIYGVNRASFVPGGLFNGTTSPANGGCRDLYDTNDELPPDESTGSSTHRLSHVTFFSFQTNQAGSIANAGSVPTYVWTRRDVDLNNTITPNRINQIPVVKAYELSSGATVVKGPGFTGGDVIRRTNIGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKK

SEQ ID NO: 276 - protein, 666 aa, Unknown
  Artificial Sequence
MPRNNQNEYEIIDASTCGCSSDDVVQYPLARDPNAVFQNMHYKDYLQTYDGDYTGSLINPNLSINPRDVLQTGINIVGRLLGFLGVPFAGQLVTFYTFLLNQLWPTNDNAVWEAFMAQIEELINQRISEAVVGTAADHLTGLHDNYELYVEALEEWLERPNAARTNLLFNRFTTLDSLFTQFMPSFGTGPGSQNYAVPLLTVYAQAANLHLLLLKDAEIYGARWGLNQNQINSFHTRQQERTQYYTNHCVTTYNTGLDRLRGTNTESWLNYHRFRREMTLMAMDLVALFPYYNVRQYPNGANPQLTREIYTDPIVYNPPANQGICRRWGNNPYNTFSELENAFIRPPHLFERLNRLTISRNRYTAPTTNSFLDYWSGHTLQSQHANNPTTYETSYGQITSNTRLFNTTNGARAIDSRARNFGNLYANLYGVSSLNIFPTGVMSEITNAANTCRQDLTTTEELPLENNNFNLLSHVTFLRFNTTQGGPLATLGFVPTYVWTREDVDFTNTITADRINQIPVVKAYELSSGATVVKGPGFTGGDVIRRTNIGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKK

SEQ ID NO: 277 - protein, 677 aa, Unknown
  Artificial Sequence
MPRNNQNEYEIIDASTCGCSSDDVVQYPLARDPNAVFQNMHYKDYLQTYDGDYTGSLINPNLSINPRDVLQTGINIVGRLLGFLGVPFAGQLVTFYTFLLNQLWPTNDNAVWEAFMAQIEELINQRISEAVVGTAADHLTGLHDNYELYVEALEEWLERPNAARTNLLFNRFTTLDSLFTQFMPSFGTGPGSQNYAVPLLTVYAQAANLHLLLLKDAEIYGARWGLNQNQINSFHTRQQERTQYYTNHCVTTYNTGLDRLRGTNTESWLNYHRFRREMTLMAMDLVALFPYYNVRQYPNGANPQLTREIYTDPIGFVNRGTSSRLSWFDWQNRANFSELERAIPDPVLSQFLNSIRIYTGILSLPVSPNTVRGRVWYGNQNQVSSANSQDVFNQTFGQVTNDRQNLSGLNIFRVDSQAANLNNSLYGVSRAEFFHDASQGSRRSVYQGYIRTSGLDNPVTQTIRTFLPGENSDTPTPEDYTHVLSAAINLTGGLRQPVTNRRSSVVMYGWTHRSLSRENTIFSDRINQIPVVKAYELSSGATVVKGPGFTGGDVIRRTNIGGFGAIRVSVTGPLTQRYRIRFRYASTIDFDFFVTRGGTTINNFRFTRTMNRGQESRYESYRTVEFTTPFNFTQSQDIIRTSIQGLSGNGEVYLDRIEIIPVNPTREAEEDLEAAKK

SEQ ID NO: 278 - protein, 680 aa, Unknown
  Artificial Sequence
MPRNNQNEYEIIDASTCGCSSDDVVQYPLARDPNAVFQNMHYKDYLQTYDGDYTGSLINPNLSINPRDVLQTGINIVGRLLGFLGVPFAGQLVTFYTFLLNQLWPTNDNAVWEAFMAQIEELINQRISEAVVGTAADHLTGLHDNYELYVEALEEWLERPNAARTNLLFNRFTTLDSLFTQFMPSFGTGPGSQNYAVPLLTVYAQAANLHLLLLKDAEIYGARWGLNQNQINSFHTRQQERTQYYTNHCVTTYNTGLDRLRGTNTESWLNYHRFRREMTLMAMDLVALFPYYNVRQYPNGANPQLTREVYTDPIVFNPPANVGLCRRWGTNPYNTFSELENAFIRPPHLFDRLNSLTISSNRFPVSSNFMDYWSGHTLRRSYLNDSAVQEDSYGLITTTRATINPGVDGTNRIESTAVDFRSALIGIYGVNRASFVPGGLFNGTTSPANGGCRDLYDTNDELPPDESTGSSTHRLSHVTFFSFQTNQAGSIANAGSVPTYVWTRRDVDLNNTITPNRINQIPLVKGFRVWGGTSVITGPGFTGGDILRRNTFGDFVSLQVNINSPITQRYRLRFRYASSRDARVIVLTGAASTGVGGQVSVNMPLQKTMEIGENLTSRTFRYTDFSNPFSFRANPDIIGISEQPLFGAGSISSGELYIDKIEIILADATFEAESDLERAQ

That which is claimed is:

1. An insecticidal polypeptide comprising an amino acid sequence having at least 90% sequence identity to SEQ ID NO: 66.

2. An isolated polynucleotide encoding the insecticidal polypeptide of claim 1.

3. The isolated polynucleotide of claim 2, wherein the isolated polynucleotide comprises a nucleic acid sequence having at least 90% sequence identity to SEQ ID NO: 10.

4. A DNA construct comprising the polynucleotide of claim 2.

5. A host cell comprising the DNA construct of claim 4.

6. The host cell of claim 5, wherein the host cell is a plant cell.

7. The host cell of claim 5, wherein the host cell is a bacterial cell.

8. A transgenic plant comprising the DNA construct of claim 4.

9. A recombinant insecticidal polypeptide having at least 95% sequence identity to the amino acid sequence of SEQ ID NO: 66, wherein the recombinant insecticidal polypeptide has insecticidal activity.

10. A composition comprising at least one recombinant insecticidal polypeptide of claim 9.

11. A recombinant polynucleotide encoding the insecticidal polypeptide of claim 9.

12. The recombinant polynucleotide of claim 11, wherein the polynucleotide has codons optimized for expression in an agriculturally important crop.

13. The recombinant polynucleotide of claim 11, wherein the recombinant polynucleotide comprises a nucleic acid sequence having at least 95% sequence identity to SEQ ID NO: 10.

14. The recombinant polynucleotide of claim 11, wherein the recombinant polynucleotide is operably linked to a heterologous promoter.

15. A DNA construct comprising the recombinant polynucleotide of claim 11 operably linked to a heterologous regulatory element.

16. A host cell transformed with the DNA construct of claim 15.

17. The host cell of claim 16, wherein the host cell is a bacterial cell or a plant cell.

18. The host cell of claim 17, wherein the plant cell is a monocot or a dicot.

19. A transgenic plant comprising the polynucleotide of claim 11.

20. A transgenic plant comprising the DNA construct of claim 15.

21. A method of inhibiting growth or killing an insect pest or pest population comprising expressing in a plant the polynucleotide of claim 11.

22. A DNA construct comprising a polynucleotide encoding an insecticidal polypeptide having at least 95% sequence identity to the amino acid sequence of SEQ ID NO: 66; and a heterologous regulatory element, wherein the heterologous regulatory element is operably linked to the polynucleotide.

23. The DNA construct of claim 22, wherein the polynucleotide comprises a nucleic acid sequence having at least 95% sequence identity to SEQ ID NO: 10.

24. A transgenic plant comprising the DNA construct of claim 22.

25. A method of inhibiting growth of, or killing, an insect pest or pest population, comprising contacting the insect pest or pest population with the insecticidal polypeptide of claim 1.

26. The method of claim 25, wherein the insect pest or pest population is resistant to at least one Cry insecticidal protein.

\* \* \* \* \*